(12) United States Patent
Chang et al.

(10) Patent No.: US 7,723,110 B2
(45) Date of Patent: May 25, 2010

(54) PLANT CELL SIGNALING GENES

(75) Inventors: Shujun Chang, Summerville, SC (US);
Marie B. Connett, Canberra (AU);
Sarah Jane Emerson, Parnell (NZ);
Richard L. Forster, Parnell (NZ);
Katrina Gause, Summerville, SC (US);
Ilkka Havukkala, Remuera (NZ);
Colleen Higgins, Parnell (NZ); Robert Kodrzycki, Summerville, SC (US)

(73) Assignee: Arborgen, LLC, Summerville, SC (US)

( * ) Notice: Subject to any disclaimer, the term of this patent is extended or adjusted under 35 U.S.C. 154(b) by 186 days.

(21) Appl. No.: 11/454,157

(22) Filed: Jun. 16, 2006

(65) Prior Publication Data
US 2007/0039071 A1    Feb. 15, 2007

Related U.S. Application Data

(60) Provisional application No. 60/691,398, filed on Jun. 17, 2005.

(51) Int. Cl.
*C12N 5/14*      (2006.01)
*C12N 15/63*     (2006.01)
*C07H 21/04*     (2006.01)

(52) U.S. Cl. .................. 435/419; 435/320.1; 536/23.1
(58) Field of Classification Search .................. None
See application file for complete search history.

(56) References Cited

U.S. PATENT DOCUMENTS

| | | |
|---|---|---|
| 6,667,502 B1 | 12/2003 | Agarwal et al. |
| 6,867,350 B2 | 3/2005 | Ferl et al. |
| 7,135,616 B2 | 11/2006 | Heard et al. |
| 2002/0107644 A1 | 8/2002 | Meglen et al. |
| 2002/0113212 A1 | 8/2002 | Meglen et al. |
| 2005/0016494 A1 | 1/2005 | Udy |
| 2005/0214263 A1 | 9/2005 | Vaistij et al. |

FOREIGN PATENT DOCUMENTS

| | | |
|---|---|---|
| EP | 0271988 B1 | 8/1995 |
| WO | WO 01/75164 A3 | 10/2001 |

OTHER PUBLICATIONS

Abeles et al., *Ethylene In Plant Biology*, 1992, pp. vii-xi, Academic Press, San Diego.
Ach et al., "A small nuclear GTP-binding protein from tomato suppresses a *Schizosaccharomyces pombe* cell-cycle mutant," *Proc. Nat'l Acad. Sci. U.S.A*, Jun. 1994, pp. 5863-5867, vol. 91.
Adams et al., "*Ethylene biosynthesis*: Identification of 1-aminocyclopropane-1-carboxylic acid as an intermediate in the conversion of methionine to ethylene," *Proc. Natl. Acad. Sci. USA*, Jan. 1979, vol. 76, No. 1, pp. 170-174.
Aharoni et al., "Novel Insight into Vascular, Stress, and Auxin-dependent-Independent gene Expression Programs in Strawberry, a Non-Climacteric Fruit," *Plant Physiol.*, Jul. 2002, pp. 1019-1031, vol. 129, American Society of Plant Biologists.
Allona et al., "Analysis of xylem formation in pine by cDNA sequencing," *Proc. Nat'l Acad. Sci.*, Aug. 1998, pp. 9693-9698, vol. 95, The National Academy of Sciences.
Aronen et al., "Seasonal changes in the transient expression of a 35S CaMV-GUS gene construct introduced into Scots pine buds," *Tree Physiol.*, Jan. 1995, pp. 65-70, vol. 15, No. 1, Heron Publishing, Victoria, Canada.
Benichou et al., "Tomato EF-Ts$_{mt}$, a functional mitochondrial translation elongation factor from higher plants," *Plant Mol. Biol.*, 2003, pp. 411-422, vol. 53, No. 3, Kluwer Academic Publishers, Netherlands.
Bent et al., "Plant Disease Resistance Genes: Function Meets Structure," *The Plant Cell*, Oct. 1996, pp. 1757-1771, vol. 8, American Society of Plant Physiologists.
Borg et al., "Identification of new protein species among 33 different small GTP-binding proteins encoded by cDNAs from *Lotus japonicus*, and expression of corresponding mRNAs in developing root nodules," *The Plant Journal*, 1997, pp. 237-250, vol. 11, No. 2.
Brandstatter et al., "Two Genes with Similarity to Bacterial Response Regulators Are Rapidly and Specifically Induced by Cytokinin in *Arabidopsis*," *The Plant Cell*, Jun. 1998, pp. 1009-1019, vol. 10, American Society of Plant Physiologists.
Chang et al., "*Arabidopsis* Ethylene-Response Gene ETR1 : Similarity of Product to Two-Component Regulators," *Science*, Oct. 1993, pp. 539-544, vol. 262, American Association for the Advancement of Science.
Cheong et al., "Transcriptional Profiling Reveals Novel Interactions between Wounding, Pathogen, Abiotic Stress, and Hormonal Responses in *Arabidopsis*," *Plant Physiol.*, Jun. 2002, pp. 661-677, vol. 129, American Society of Plant Biologists.
Chiang et al., "Isolation of the *Arabidopsis* GA4 Locus," *The Plant Cell*, Feb. 1995, pp. 195-201, vol. 7, American Society of Plant Physiologists.
Chory et al., "Gibberellins, brassinosteroids and light-regulated development," *Plant, Cell and Environ.*, 1997, pp. 801-806, vol. 20, Blackwell Science Ltd.
Colucci et al., "GCR1, the putative *Arabidopsis* G protein-coupled receptor gene is cell cycle-regulated, and its overexpression abolishes seed dormancy and shortens time to flowering," *Proc. Nat'l Acad. Sci. U.S.A*, Apr. 2002, pp. 4736-4741, vol. 99, No. 7.
Cooke et al., "Hormonal control of tobacco protoplast nucleic acid metabolism during in vitro culture," *Planta*, 1981, pp. 1-7, vol. 152, No. 1, Springer-Verlag.

(Continued)

*Primary Examiner*—Ruixiang Li
(74) *Attorney, Agent, or Firm*—Foley & Lardner LLP

(57) ABSTRACT

Novel plant cell signaling genes and gene products are provided. These gene, polypeptide and oligonucleotide sequences are useful in regulating plant phenotype. Moreover, these genes and gene products are useful for expression profiling of plant cell signaling genes. The invention specifically provides polynucleotide and polypeptide sequences isolated from *Eucalyptus* and *Pinus* species.

8 Claims, 215 Drawing Sheets

OTHER PUBLICATIONS

Daitoku et al., "Dimerization of small GTPase Rab5," *Int. J. Mol. Med.*, Oct. 2001, pp. 397-404, vol. 8, No. 4.

Drew et al., "Sequence of a novel plant ras-related cDNA from *Pisum sativum*," *Plant Mol. Biol.* 1993, vol. 21, pp. 1195-1199.

Elbashir et al., "Analysis of gene function in somatic mammalian cells using small interfering RNAs," *Methods Enzymol.*, 2002, pp. 199-213, vol. 26, Academic Press.

Elbashir et al., "Duplexes of 21-nucleotide RNAs mediate RNA interference in cultured mammalian cells," *Nature*, May 2001, pp. 494-498, vol. 411, Macmillan Magazines Ltd.

Elbashir et al., "Functional anatomy of siRNAs for mediating efficient RNAi in *Drosophila melanogaster* embryo lysate," *EMBO J.*, 2001, pp. 6877-6888, vol. 20, No. 23, European Molecular Biology Organization.

Ellis et al., "Expression of inducible angiosperm promoters in a gymnosperm," *Picea glauca* (white spruce), *Plant Mol. Biol.*, Jul. 1991, pp. 19-27, vol. 17, No. 1, Kluwer Academic Publishers.

Feng et al., "Rab 7: An Important Regulator of Late Endocytic Membrane Traffic," *J. Cell Biol.*, Dec. 1995, pp. 1435-1452, vol. 131, No. 6, The Rockefeller University Press.

Gastal et al., "Nitrogen Use within the Growing Leaf Blade of Tall Fescue," *Plant Physiol.*, 1994, pp. 191-197, vol. 105.

Ghosh et al., "Assay for G Protein-Dependent Activation of Phospholipase C β Using Purified Protein Components," *Methods Mol. Biol.*, 2004, pp. 67-75, vol. 237, Humana Press, Totowa, NJ.

Gilmour et al., "Gibberellin Metabolism in Cell-Free Extracts from Spinach Leaves in Relation to Photoperiod," *Plant Physiol.*, Sep. 1986, pp. 190-195, vol. 82, No. 1, The American Society of Plant Physiologists.

Gorvel et al., "rab5 Controls Early Endosome Fusion In Vitro," *Cell*, Mar. 1991, pp. 915-925, vol. 64, No. 5, Cell Press.

Green et al., "Grain Development Mutants of Barley," *Plant Physiol.*, 1997, pp. 203-212, vol. 114, No. 1.

Haberer et al., "Cytokinins. New Insights into a Classic Phytohormone," *Plant Physiol.*, Feb. 2002, pp. 354-362, vol. 128, American Society of Plant Biologists.

Haizel et al., "Characterization of Membrane-Bound Small GTP-Binding Proteins from *Nicotiana tabacum*," *Plant Physiol.*, 1995, pp. 59-67, vol. 108.

Harborth et al., "Identification of essential genes in cultured mammalian cells using small interfering RNAs," *J. Cell Sci.*, Oct. 2001, pp. 4557-4565, vol. 114, The Company of Biologists Ltd.

Hedden et al., "Gibberellin Biosynthesis: Enzymes, Genes and Their Regulation," Annu. Rev. Plant Physiol. *Plant Mol. Biol.*, 1997, pp. 431-460, vol. 48, Annual Reviews, Inc.

Hemerly et al., "cdc2a Expression in *Arabidopsis* Is Linked with Competence for Cell Division," *The Plant Cell*, Dec. 1993, pp. 1711-1723, vol. 5, American Society of Plant Physiologists.

Hertzberg et al., "cDNA microarray analysis of small plant tissue samples using a cDNA tag target amplification protocol," *Plant Journal*, 2001, pp. 585-591, vol. 25, No. 5, Blackwell Science Ltd.

Hertzberg et al., "A transcriptional roadmap to wood formation," *Proc. Nat'l Acad. Sci.*, Dec. 2001, pp. 14732-14737, vol. 98, No. 25.

Hooley et al., "Plant hormone perception and action: a role for G-protein signal transduction?," *Phils. Trans. R. Soc. Lond. B.*, 1998, pp. 1425-1430, vol. 353, The Royal Society.

Houba-Hérin et al., "cytokinin oxidase from *Zea mays* : purification, cDNA cloning and expression in moss protoplasts," *Plant Journal*, 1999, pp. 615-626, vol. 17, No. 6, Blackwell Science Ltd.

Hua et al., "Ethylene Responses Are Negatively Regulated by a Receptor Gene Family in *Arabidopsis thaliana*," *Cell*, Jul. 1998, pp. 261-271, vol. 94, Cell Press.

Huang et al., "*Agrobacterium rhizogenes*-Mediated Genetic Transformation and Regeneration of a Conifer: *Larix decidua*," *In Vitro Cell*, 27:201-207, Oct. 1991, Tissue Culture Association.

Huang et al., "Overexpression of 20-Oxidase Confers a Gibberellin-Overproduction Phenotype in *Arabidopsis*," *Plant Physiol.*, 1998, pp. 773-781, vol. 118, No. 3.

Huang et al., "Phosphorylation of Synthetic Peptides by a CDPK and Plant SNF1-Related Protein Kinase. Influence of Proline and Basic Amino Acid Residues at Selected Positions," *Plant Cell Physiol.*, 2001, pp. 1079-1087, vol. 42, No. 10, JSPP.

Hutchison et al., "Cytokinin Signaling in *Arabidopsis*," *The Plant Cell*, Supplement 2002, pp. S47-59, vol. 14, American Society of Plant Biologists.

Hutvágner et al., "a Cellular Function for the RNA-Interference Enzyme Dicer in the Maturation of the let-7 Small Temporal RNA," *Science*, Aug. 2001, pp. 834-838, vol. 293.

Kakimoto, CKL1, "a Histidine Kinase Homolog Implicated in Cytokinin Signal Transduction," *Science*, Nov. 1996, pp. 982-985, vol. 274, American Association for the Advancement of Science.

Kirst et al., "Analysis of Microarray Gene Expression Levels as Quantitative Traits: Discovery of Candidate Genes, Regulatory Networks and Mapping of Gene Expression QTLS," *Int'l Union of Forestry Research Organizations Biennial Conference.* S6.8 (Jun. 2003, Umea, Sweden).

Koornneef et al., "Induction and Analysis of Gibberellin Sensitive Mutants in *Arabidopsis thaliana* (L.) Heynh.," *Theor. Appl. Genet.*, 1980, pp. 257-263, vol. 58, No. 6, Springer-Verlag.

Lagos-Quintana et al., "Identification of Novel Genes Coding for Small Expressed RNAs, *Science*," Oct. 2001, pp. 853-858, vol. 294.

Lagos-Quintana et al., "Identification of Tissue-Specific MicroRNAs from Mouse," *Curr. Biol.*, Apr. 2002, pp. 735-739, vol. 12, Elsevier Science Ltd.

Li et al., "Conservation of function between mammalian and plant steroid 5α-reductases," *Proc. Natl. Acad. Sci. U.S.A*, Apr. 1997, pp. 3554-3559, vol. 94, No. 8.Li et al.

Li et al., "A Putative Leucine-Rich Repeat Receptor Kinase Involved in Brassinosteroid Signal Transduction," *Cell*, Sep. 1997, pp. 929-938, vol. 90, Cell Press.

Li et al., "A Role for Brassinosteroids in Light-Dependent Development of *Arabidopsis*," *Science*, Apr. 1996, pp. 398-401, vol. 272, American Association for the Advancement of Science.

Lovegrove et al., "Gibberellin and abscisic acid signalling in aleurone," *Trends Plant Sci.*, Mar. 2000, pp. 102-110, vol. 5, No. 3, Elsevier Science Ltd.

Lovegrove et al., "Gibberellin-photoaffinity labelling of two polypeptides in plant plasma membranes," *Plant Journal*, 1998, pp. 311-320, vol. 15, Blackwell Science Ltd.

Mandava, "Plant Growth-Promoting Brassinosteroids," *Annu. Rev. Plant Physiol. Plant Mol. Biol.*, 1988, pp. 23-52, vol. 39, Annual Reviews Inc., Palo Alto, CA.

Marita et al., "NMR characterization of lignins from transgenic poplars with suppressed caffeic acid O-methyltransferase activity", *J. Chem. Soc.*, Perkin Trans. 1, 2001, pp. 2939-2945, The Royal Society of Chemistry.

Martin et al., "A Gene Encoding the Cytokinin Enzyme Zeatin O-Xylosyltransferase of *Phaseolus vulgaris*," *Plant Physiol.*, 1999, pp. 553-557, vol. 120, American Society of Plant Physiolgists.

Martin et al., "Isolation of a cytokinin gene, ZOG1, encoding zeatin O-glucosyltransferase from *Phaseolus lunatus*," *Proc. Natl. Acad. Sci. USA*, Jan. 1999, pp. 284-289, vol. 96.

Martin et al., "A maize cytokinin gene encoding an O'glucosyltransferase specific to cis-zeatin," *Proc. Natl. Acad. Sci. USA*, May 2001, pp. 5922-5926, vol. 98, No. 10.

Martinez et al., "Single-Stranded Antisense siRNAs Guide Target RNA Cleavage in RNAi," *Cell*, Sep. 2002, pp. 563-574, vol. 110, Cell Press.

McManus et al., "Gene Silencing in Mammals by Small Interfering RNAs," *Nature Rev. Genetics*, Oct. 2002, pp. 737-747, vol. 3, Nature Publishing Group.

Mok et al., *Cytokinins: Chemistry, Activity and Function*, 1994, Index pages, CRC Press, Boca Raton, FL.

Mok et al., "Cytokinin Metabolism and Action," *Annu. Rev. Plant Physiol. Plant Mol. Biol.*, 2001, pp. 89-118, vol. 52, Annual Reviews.

Morris et al., "Isolation of a Gene Encoding a Glycosylated Cytokinin Oxidase from Maize," *Biochem. Biophys. Res. Commun.*, 1999, pp. 328-333, vol. 255, No. 2, Academic Press.

Mukhopadhyay et al., "Rab7 Regulates Transport from Early to Late Endocytic Compartments in *Xenopus* Oocytes," *J. Biol. Chem.*, May 1997, pp. 13055-13059, vol. 272, No. 20, The American Society for Biochemistry and Molecular Biology, Inc., USA.

Nagasawa et al., "A novel nitrilase, arylacetronitrilase, of *Alcaligenes faecalis* JM3 Purification and characterization," *Eur. J. Biochem.*, Dec. 1990, pp. 765-772, vol. 194, No. 3, FEBS.

Newmark et al., "*Mago nashi* mediates the posterior follicle cell-to-oocyte signal to organize axis formation in *Drosophila*," *Development*, 1997, pp. 3197-3207, vol. 124, No. 16, The Company of Biologists Limited, GB.

Normanly et al., "Rethinking Auxin Biosynthesis and Metabolism," *Plant Physiol.*, 1995, pp. 323-329, vol. 107.

Peng et al., "The *Arabidopsis* GAI gene defines a signaling pathway that negatively regulates gibberellin responses," *Genes & Dev.*, 1997, pp. 3194-3205, vol. 11, No. 23, Cold Spring Harbor Laboratory Press.

Peng et al., "Gibberellin Deficiency and Response Mutations Suppress the Stem Elongation Phenotype of Phytochrome-Deficient Mutants of *Arabidopsis* "*Plant Physiol.*, 1997, pp. 1051-1058, vol. 113.

Pettersen et al., "Wood sugar Analysis by Anion Chromatography," *J. Wood Chem. & Technol.*, 1991, pp. 495-501, vol. 11, No. 4, Marcel Dekker, Inc.

Plakidou-Dymock et al., "A higher plant seven-transmembrane receptor that influences sensitivity to cytokkinins," *Curr. Biol.*, 1998, pp. 315-324, vol. 8, No. 6.

Potuschak et al., "EIN3-Dependent Regulation of Plant Ethylene Hormone Signaling by Two *Arabidopsis* F Box Proteins: EBF1 and EBF2," *Cell*, Dec. 2003, pp. 679-689, vol. 115, No. 6, Cell Press.

Riou-Khamlichi et al., "Cytokinin Activation of *Arabidopsis* Cell Division Through a D-Type Cyclin," *Science*, Mar. 1999, pp. 1541-1544, vol. 283.

Ross et al., "Genetic regulation of gibberellin deactivation in *Pisum*," *Plant J.*, 1995, pp. 513-523, vol. 7, No. 3.

Rouleau et al., "Inactivation of Brassinosteroid Biological Activity by a Salicylate-inducible Steroid Sulfotransferase from *Brassica napus*," *J. Biol. Chem.*, Jul. 1999, pp. 20925-20930, vol. 274, No. 30. The American Society for Biochemistry and Molecular Biology, Inc.

Sacks et al., "Effect of Water Stress on Cortical Cell Division Rates within the Apical Meristem of Primary Roots of Maize," *Plant Physiol.*, 1997, pp. 519-527, vol. 114.

Sakai et al., "ETR2 is an ETR1-like gene involved in ethylene signaling in *Arabidopsis*," *Proc. Natl. Acad. Sci. U.S.A*, May 1998, pp. 5812-5817, vol. 95, No. 10, The National Academy of Sciences.

Sakamoto et al., "Expression of a Gibberellin 2-Oxidase Gene around the Shoot Apex Is Related to Phase Transition in Rice," *Plant Physiol.*, Mar. 2001, pp. 1508-1516, vol. 125, No. 3, American Society of Plant Physiologists.

Salah et al., "Temperature Affects Expansion Rate of Maize Leaves without Change in Spatial Distribution of Cell Length," *Plant Physiol.*, 1995, pp. 861-870, vol. 109.

Schaller et al., "Ethylene-Binding Sites Generated in Yeast Expressing the *Arabidopsis* ETR1 Gene," *Science*, Dec. 1995, pp. 1809-1811, vol. 270, American Association for the Advancement of Science.

Schenk et al., "Coordinated plant defense responses in *Arabidopsis* revealed by microarray analysis," *Proc. Nat'l Acad. Sci.*, Oct. 2000, pp. 11655-11660, vol. 97, No. 21.

Schmulling et al., "Structure and function of cytokinin oxidase/dehydrogenase genes of maize, rice, *Arabidopsis* and other species," *J. Plant Res.*, Jun. 2003, pp. 241-252, vol. 116, No. 3, The Botanical Society of Japan and Springer-Verlag, Tokyo.

Skoog et al., "Chemical Regulation of Growth and Organ Formation in Plant Tissues Cultured In Vitro," *Symp. Soc. Exp. Biol.*, 1957, pp. 118-131, vol. 11, Cambridge: University Press.

Smart et al., "Delayed Leaf Senescence in Tobacco Plants Transformed with tmr, a Gene for Cytokinin Production in *Agrobacterium*," *Plant Cell*, Jul. 1991, pp. 647-656, vol. 3, American Society of Plant Physiologists.

Smith et al., "Antisense RNA inhibition of polygalacturonase gene expression in transgenic tomatoes," *Nature*, Aug. 25, 1988, pp. 724-726, vol. 334.

Smith et. al., "Inheritance and effect on ripening of antisense polygalacturonase genes in transgenic tomatoes," *Plant Mol. Biol.*, 1990, pp. 369-379, vol. 14.

Sohn et al., "Rha1, an *Arabidopsis* Rab5 Homolog, Plays a Critical Role in the Vacuolar Trafficking of Soluble Cargo Proteins," *Plant Cell*, May 2003, pp. 1057-1070, vol. 15, American society of Plant Biologists.

Song et al., "A Receptor Kinase-Like Protein Encoded by the Rice Disease Resistance Gene, Xa21," *Science*, Dec. 1995, pp. 1804-1806, vol. 270.

Strom et al., "A yeast GTPase-activating protein that interacts specifically with a member of the Ypt/Rab family," *Nature*, Feb. 1993, pp. 736-739, vol. 361, No. 6414.

Sun et al., "Cloning the *Arabidopsis* GA1 Locus by Genomic Subtraction," *Plant Cell*, Feb. 1992, pp. 119-128, vol. 4, American Society of Plant Physiologists.

Swidzinski et al., "Molecular characterization and expression analysis of a highly conserved rice mago nashi homolog," *Genome*, 2001, pp. 394-400, vol. 44, No. 3, NRC Canada.

Szekeres et al., "Brassinosteroids Rescue the Deficiency of CYP90, a Cytochrome P450, Controlling Cell Elongation and De-etiolation in *Arabidopsis*," *Cell*, Apr. 1996, pp. 171-182, vol. 85, Cell Press.

Thibaud-Nissen et al., "Clustering of Microarray Data Reveals Transcript Patterns Associated with Somatic Embryogenesis in Soybean," *Plant Physiol.*, May 2003, pp. 118-136, vol. 132, American Society of Plant Biologists.

Thimann et al., "On the Inhibition of Bud Development and other Functions of Growth Substance in *Vicia faba.*," *Proc. R. Soc. Lond.* Series B [Biol.], Mar. 1934, pp. 317-339, vol. 114.

Thornton et al., "Gibberellin signal transduction presents . . . the SPY who O'GlcNAc'd me," *Trends Plant Sci.*, Nov. 1999, pp. 424-428, vol. 4, No. 11, Elsevier Science Ltd.

Tuschl, "Expanding small RNA interference," *Nature Biotechnol.*, May 2002, pp. 446-448, vol. 20, Nature Publishing Group.

Tuschl, "RNA Interference and Small Interfering RNAs," *Chembiochem.*, 2001, pp. 239-245, vol. 2, WILEY-VCH-Verlag GmbH.

Vernoud et al., "Analysis of the Small GTPase Gene Superfamily of *Arabidopsis*," *Plant Physiol.*, Mar. 2003, pp. 1191-1208, vol. 131, American Society of Plant Biologists.

Werner et al., "Regulation of plant growth by cytokinin," *Proc. Natl. Acad. Sci. USA*, Aug. 2001, pp. 10487-10492, vol. 98, No. 18.

Whetten et al., "Functional genomics and cell wall biosynthesis in loblolly pine," *Plant Mol. Biol.*, 2001, pp. 275-291, vol. 47, Kluwer Academic Publishers, Netherlands.

Xu et al., "The GA5 locus of *Arabidopsis thaliana* encodes a multifunctional gibberellin 20-oxidase: Molecular cloning and functional expression," *Proc. Natl. Acad. Sci. USA*, Jul. 1995, pp. 6640-6644, vol. 92, No. 14.

Yang et al., "Ethylene Biosynthesis and its Regulations in Higher Plants," *Annu. Rev. Plant Physiol.*, 1984, pp. 155-189, vol. 35,, Annual Reviews Inc., Palo Alto, CA.

Ye et al., "Determination of $S_2$-fibril-angle and fiber-wall thickness by microscopic transmission ellipsometry," *Tappi J.*, Jun. 1997, pp. 181-190, vol. 80, No. 6.

Zhang et al., "Involvement of phosphoinositide turnover in tracheary element differentiation in *Zinnia elegans* L. cells," *Planta*, 2002, pp. 312-318, vol. 215, Springer-Verlag.

The Translation of the Office Action for the corresponding Chilean Patent Application No. 1544-2006, dated Dec. 22, 2008. (3 pgs.).

FIGURE 1: Amino acid sequence of SEQ ID NO: 198. The conserved 14-3-3 protein family domain is underlined.

MERE<u>REQQVYQARLAEQAERYDEMVESMKQVAKLDVELTVEERNVLSVGY</u>
<u>KNVIGARRASWRILSSIEQKEGTKGNEQNVKRIKDYRQRVEDELAKICSDILS</u>
<u>VIDKHLIPSSSSGESTVFYYKMKGDYCRYLAEFKAGDDRKEAADQSLKAYEA</u>
<u>ASSTASTDLAPTHPIRLGLALNFSVFYYEIMNSPERACHLAKQAFDEAIAELD</u>
<u>SLNEDSYKDSTLIMQLLRDNLTLWTTDLPEEG</u>GEQSKVDEPAAES

FIGURE 2: Amino acid sequence of SEQ ID NO: 199. The conserved 14-3-3 protein family domain is underlined and the 14-3-3 proteins signatures 1 and 2 are in bold.

MSPSDSSREEYVYMAKLAEQAERYEEMVDFMEKVAKTVDVEELTVEERNL
LSVAYKNVIGARRASWRIISSIEQKEESRGNTDHVSIIKDYRGKIESELSKICE
GILSLLESHLIPSASSAESKVFYLKMKGDYHRYLAEFKTATERKEAAESTLLA
YKSAQDIAGAELASTHPIRLGLALNFSVFYYEILNSPDRACALAKQAFDEAIAE
LDTLGEESYKDSTLIMQLLRDNLTLWTSDLTDEAGDDIKEASKLESGEGQQ

FIGURE 3: Amino acid sequence of SEQ ID NO: 200. The conserved 14-3-3 protein family domain is underlined and the 14-3-3 proteins signatures 1 and 2 are in bold.

MAAADSS<u>REENVYMAKLAEQAERYEEMVEFMEKVAKTVDVEELTVEERNL</u>
<u>LSVAYKNVIGARRASWRIISSIEQKEESRGNEDHVVIIKEYRGKIETELSKICD</u>
<u>GILNLLESHLVPSASSAESKVFYLKMKGDYHRYLAEFKAGTERKEAAESTLL</u>
<u>AYKSAQDIALAELAPTHPIRLGLALNFSVFYYEILNSPDRACSLAKQAFDEAIS</u>
<u>ELDTLGEESYKDSTLIMQLLRDNLTLWTS</u>DVTDEAGDEIKESSKRESGEGQ
PPQ

FIGURE 4: Amino acid sequence of SEQ ID NO: 201. The conserved 14-3-3 protein family domain is underlined and the 14-3-3 proteins signatures 1 and 2 are in bold.

MASTKERDGYVYVAKLAEQAERYDEMVEAMKNVAKLDVELTVEERNLLSV
GYKNVIGARRASWRILSSIEQKEDSKGNEHNVKKIKEFRQKVEAELANICGD
VMKVIDEHLIPSCAGGESTVFFYKMKGDYYRYLAEFKAGDDRKEAADQSMK
AYELASTTAEADLSPTHPIRLGLALNFSVFYYEIMNSPERACHLAKQAFDEAI
SELDTLSEESYKDSTLIMQLLRDNLTLWTSDIPEDGAEDAQKLDNAAKAAG
GEDAE

FIGURE 5: Amino acid sequence of SEQ ID NO: 206. The conserved 14-3-3 protein family domain is underlined and the 14-3-3 proteins signatures 1 and 2 are in bold.

MAVPENLG<u>RDQYVYLAKLAEQAERYEEMVEFMHKLVVGWTPAAELTVEE</u>R
NLLSVAYKNV<u>IGSLRAAWRIVSSIEQKEEGRKNEDHVVLVKEYRSKVENELS</u>
<u>DVCASILRLLDTNLVPSAAASESKVFYLKMKGDYHRYLAEFKVGDERKAAAE</u>
<u>DTMLAYKAAQDIAQADLASTHPIRLGLALNFSVFYYEILNQSDKACSMAKQAF</u>
<u>EEAIAELDTLGEES</u>YKDSTLIMQLLRDNFTLWTS<u>DVQDQLDEP</u>

FIGURE 6: Amino acid sequence of SEQ ID NO: 207. The conserved 14-3-3 protein family domain is underlined and the 14-3-3 proteins signatures 1 and 2 are in bold.

MATAPSAREENVYMAKLAEQAERYEEMVEFMEKVAAAAAAADAEELTIEER
NLLSVAYKNVIGARRASWRIISSIEQKEESRGNEDHVAAIRDYRSKIESELSGI
CAGILKLLDSRLIPAAASGDSKVFYLKMKGDYHRYLAEFKTGAERKEAAEST
LTAYKAAQDIANTELAPTHPIRLGLALNFSVFYYEILNSPDRACSLAKQAFDE
AIAELDTLGEESYKDSTLIMQLLRDNLTLWTSDMQEDGADEIKEAPKADEQQ

FIGURE 7: Amino acid sequence of SEQ ID NO: 208. The conserved 14-3-3 protein family domain is underlined and the 14-3-3 proteins signatures 1 and 2 are in bold.

MAAAAPPPSSPREEYVYMAKLAEQAERYEEMVEFMEKVSAAAADAEEELTV
EERNLLSVAYKNVIGARRASWRIISSIEQKEESRGNEDHVAAIRDYRAKIEAE
LSKICDGILGLLDTRLIPAASVGDSKVFYLKMKGDYHRYLAEFKTGTERKEAA
ESTLTAYKAAQDIANSELAPTHPIRLGLALNFSVFYYEILNSPDRACGLAKQA
FDEAIAELDTLGEESYKDSTLIMQLLRDNLTLWTSDMQDDGVDEIKETAKAD
EQ

FIGURE 8: Amino acid sequence of SEQ ID NO: 227. The conserved 14-3-3 protein family domain is underlined and the 14-3-3 proteins signatures 1 and 2 are in bold.

MDSSRESLVYVAKLAEQAERYEEMVDEMKKVAKLNVALTVEERNLLSVGYK
NVIGARRASWRILTSIEQKEDARGNEISVKRIKEYRKKVESELSSICSDIMVILD
EHVIPSASDGESKVFYYKMKGDYYRYLAEFKSDDEKKEVAEQSMKAYEMAT
SIAESDLPYTHPIRLGLALNFSVFYYEILNSAERACHIAKQAFDDAIAELDNLN
EESYKDSTLIMQLLRDNLTLWTSDITEEGEDAQRINGSAKVGMEEGE

FIGURE 9: Amino acid sequence of SEQ ID NO: 283. The conserved 14-3-3 protein family domain is underlined and the 14-3-3 proteins signatures 1 and 2 are in bold.

MPES<u>REDSVYLAKLAEQAERYEEMVENMKRVASSDQELTVEERNLLSVAY KNVIGARRASWRIVSSIEQKEESKGNEAQVSMIKGYREKIEQELAKICEDILE VLDKHLIPSAASGESKVFYHKMMGDYHRYLAEFATGDKRKDSADKSLEAYK AASDVAVTELPPTHPIRLGLALNFSVFYYEILNSPDRACHLAKQAFDDAIAEL DTLSEESYKDSTLIMQLLRDNLTLWTS</u>DMQDSADKPADTKEEAGDAPAED

FIGURE 10: Amino acid sequence of SEQ ID NO: 290. The conserved 14-3-3 protein family domain is underlined and the 14-3-3 proteins signatures 1 and 2 are in bold.

MSAEKERESHVFMAKLAEQAERYDEMVQSMKDVAKLDLELSVEERNLLSV
GYKNVIGARRASWRIMSSIEQKEEAKGNEQNAKRIRDYRQKVEDELCRICND
ILSIIDDHLLPSSTSGESTVFYYKMKGDYYRYLAEFKSGNERKEIADQSLKAY
EAASNTAATDLPPTHPIRLGLALNFSVFYYEIQNSPERACHLAKQAFDEAIAE
LDTLSEESYKDSTLIMQLLRDNLTLWSSDLEDLGGDDQPKGEEAKVEDGEP

FIGURE 11: Amino acid sequence of SEQ ID NO: 296. The conserved 14-3-3 protein family domain is underlined and the 14-3-3 proteins signatures 1 and 2 are in bold.

MTTEKERENHVYMAKLAEQAERYDEMVDSMKKVAKLDVELTVEERNLLSV GYKNVIGARRASWRIMSSIEQKEEGKGNDVNAKRIKDYRHKVETELSRICGD ILTIIDEHLIPSSSSGESMVFYYKMKGDYYRYLAEFKSGSDRKETADQALKAY LAASTTATTDLPPTHPIRLGLILNFSVFYYEILNSPERACHLAKQAFDEAIAELD SLSEESYKDSTLIMQLLRDNLTLWTSDLQEDGGEEQLKGEEIKPEDGEH

FIGURE 12: Amino acid sequence of SEQ ID NO: 307. The conserved 14-3-3 protein family domain is underlined and the 14-3-3 proteins signatures 1 and 2 are in bold.

MSSDKE<u>RENHVYMAKLAEQAERYDEMVEAMKRVAKLDVELTVEERNLLSV GYKNVIGARRASWRIMSSIEQKEDAKGNDHNVKRIKEYRQKVEAELSKICHD IMTIIDEHLIPSSNIGESTVFYYKMKGDYYRYLAEFKTGNERKEAADQSLKAY QTASSTAESDLAPTHPIRLGLALNFSVFYYEIMNSPERACHLAKQAFDEAIAE LDTLSEESYKDSTLIMQLLRDNLTLWTSDLQEDG</u>VEDQTKGDEPVVGMDEE L

FIGURE 13: Amino acid sequence of SEQ ID NO: 308. The conserved 14-3-3 protein family domain is underlined and the 14-3-3 proteins signatures 1 and 2 are in bold.

MSSDKERENHVYMAKLAEQAERYDEMVEAMKRVAKLDVELTVEERNLLSV
GYKNVIGARRASWRIMSSIEQKEDAKGNDHNVKRIKEYRQKVEAELSKICHD
IMTIIDEHLIPSSNIGESTVFYYKMKGDYYRYLAEFKTGNERKEAADQSLKAY
QTASSTAESDLAPTHPIRLGLALNFSVFYYEIMNSPERACHLAKQAFDEAIAE
LDTLSEESYKDSTLIMQLLRDNLTLWTSDLQEDGVEDQTKGDEPVVGMDEE
L

FIGURE 14: Amino acid sequence of SEQ ID NO: 309. The conserved 14-3-3 protein family domain is underlined and the 14-3-3 proteins signatures 1 and 2 are in bold.

MVESS<u>REENVYMAKLAEQAERYEEMVEFMEKVTKGVEVEELTVEERNLLS</u>
<u>VAYKNVIGARRASWRIISSIEQKEESRGNDEHVVTIREYRAKVEAELSKICEGI</u>
<u>LRLLDSHLIPSSTAAESKVFYLKMKGDYHRYLAEFKTGAERKEAAENTLLAY</u>
<u>KSAQDIAAAELAPTHPIRLGLALNFSVFYYEILNSPDRACNLAKQAFDEAIAEL</u>
<u>DTLGEDSYKDSTLIMQLLRDNLTLWTS</u>DMQEDAGEEIKETSKREDGEEQ

FIGURE 15: Amino acid sequence of SEQ ID NO: 320. The conserved 14-3-3 protein family domain is underlined and the 14-3-3 proteins signatures 1 and 2 are in bold.

MTEKE<u>RENHVYMAKLAEQAERYDEMVDSMKKVAKLDVELTVEERNLLSVG</u>
<u>YKNVIGARRASWRIMSSIEQKEEAKGNELNVKRIKEYRHKVEDELSRICNDIL</u>
<u>TIIDEHLIPSSSTGESTVFYYKMKGDYYRYLAEFKTGNERKEAADQSLKAYQA</u>
<u>ASNTATTDLAPTHPIRLGLALNFSVFYYEILNSPERACHLAKQAFDEAIAELDT</u>
<u>LSEESYKDSTLIMQLLRDNLTLWTS</u>DLQEEGGEDQPKGEEDKIEEIEH

FIGURE 16: Amino acid sequence of SEQ ID NO: 377. The conserved 14-3-3 protein family domain is underlined and the 14-3-3 proteins signature 1 is in bold.

MADSSV<u>RSESVYMSKLAEQAERYDEMVEYMGKVVKAADVEELAVEERNLL
SVSYKNAIGSRRASWRIVSSIEQKEESRGNEDRLPLIRQYRLKVEAELSGICD
SILGLLDGYLIPSASCGEAKVFYLKMKGDYNRYLAEFKTGDERKEAADGTLE
AYKNAQGIALVELASTHPIRLGLALNFSVFYYEIMNMPEKACALAKQAFDEAI
AELDTLGEESYKDSTLIMQLLRDNLTLWTSDMQEQL</u>DDS

FIGURE 17: Amino acid sequence of SEQ ID NO: 382. The conserved 14-3-3 protein domain is underlined and the 14-3-3 proteins signatures 1 and 2 are in bold.

MSPAESS<u>REESVYMAKLAEQAERYEEMVEYMEKVAKTVDVEELTVEERNL</u>
<u>LSVAYKNVIGARRASWRIISSIEQKEESRGNEEHVTMIREYRGKVESELSNIC</u>
<u>DGILRLLDTHLIPSSTSGESKVFYLKMKGDYHRYLAEFKTGAERKEAAESTLL</u>
<u>AYKAAQDIATAELAPTHPIRLGLALNFSVFYYEILNSPDRACTLAKQAFDEAIA</u>
<u>ELDTLGEESYKDSTLIMQLLRDNLTLWTS</u>DMQEETGGDEIKEAPKKEEGDG
H

FIGURE 18: Amino acid sequence of SEQ ID NO: 388. The conserved 14-3-3 protein domain is underlined and the 14-3-3 proteins signatures 1 and 2 are in bold.

MPET<u>REDSVYLAKLAEQAERYEEMVENMKRVASSDQELTVEERNLLSVAY</u>
<u>KNVIGARRASWRIVSSIEQKEESKGNEAQVSMIKGYREKIESELAKICEDILDV</u>
<u>LDKHLIPSAASGESKVFYHKMMGDYHRYLAEFATGDKRKDSADKSLEAYKA</u>
<u>ASEVAVTELPPTHPIRLGLALNFSVFYYEILNSPDRACHLAKQAFDDAIAELDT</u>
<u>LSEESYKDSTLIMQLLRDNLTLWTS</u>DMQDSADKPADSKDEPAETPAED

FIGURE 19: Amino acid sequence of SEQ ID NO: 389. The conserved 14-3-3 protein domain is underlined and the 14-3-3 proteins signature 1 is in bold.

MANE<u>RESKTFLARLCEQAERYDEMVTYMKEVAKIGGELTVDERNLLSVAYK</u>
<u>NVVGTRRASWRIISSIEQKEESKGTDKHVGTIRDYRQKIETELEKVCQDVLDV</u>
<u>LDESLIPKAETGESKVFYHKMKGDYHRYLAEFASGEKRKNAATAAHEAYKS</u>
<u>ATDVAQTELTPTHPIRLGLALNFSVFYYEILNSPDRACHLAKQAFDDAIAELD</u>
<u>SLSEESYRDSTLIMQLLRDNLTLWTSSDGAEPAETGEA</u>PKTEEAKPAETAEA
APAEPESKPAKEEEPAAPAAA

FIGURE 20: Amino acid sequence of SEQ ID NO: 392. The conserved 14-3-3 protein domain is underlined and the 14-3-3 proteins signatures 1 and 2 are in bold.

MSPSDSS<u>REEYVYMAKLAEQAERYEEMVDFMEKVAKTVDVEELTVEERNL</u>
<u>LSVAYKNVIGARRASWRIISSIEQKEESRGNTDHVSIIKDYRGKIESELSKICE</u>
<u>GILSLLESHLIPSASSAESKVFYLKMKGDYHRYLAEFKTATERKEAAESTLLA</u>
<u>YKSAQDIAGAELASTHPIRLGLALNFSVFYYEILNSPDRACALAKQAFDEAIAE</u>
<u>LDTLGEESYKDSTLIMQLLRDNLTLWTSDLTDEAGDDIKE</u>ASKLESGEGQQ

FIGURE 21: Amino acid sequence of SEQ ID NO: 230. The conserved 2OG-Fe(II) oxygenase superfamily domain is underlined.

MESFPVINMENLNGEKRAITMDKIKDACENWGFFELVNHGIPPEFMDTIESM
TKGHYKKCMEQRFGELVASKGLECVQTEVHDLDWESTFHLKHLPVSNISQI
PDLDDDYRRVMKEFALKLEKLAEELMDLLCENLGLEKGYLKKAFYGSQG<u>PN</u>
<u>FGTKVSNYPPCPKPDLIKGLRAHTDAGGIILLFQDDKVSGLQLLKDGQWVDV</u>
<u>PPMRHSIVVNLGDQIEVITNGKYKSILHRVVAQTDGNRMSIASFYNP</u>GSDAVI
YPAPALVESEAEEASKAVYPKFVFEDYMKLYAALKFQAKEPRFQAMKAMES
SPSLGPIATA

FIGURE 22: Amino acid sequence of SEQ ID NO: 231. The conserved 2OG-Fe(II) oxygenase superfamily domain is underlined.

MESFPVINMENLNGEKRAITMDKIKDACENWGFFELVNHGIPPEFMDTVER
MTKGHYRKCMDQRFRELVASKGLENVQTEVHDLDWESTFHLKHLPLSNISQ
VPDLEDDYRKVMKEFAVKLEKLAEELMDLLCENLGLEKGYLKKAFHGSNG<u>P</u>
<u>NFGTKVSNYPPCPKPELIKGLRAHTDAGGVILLFQDDKVSGLQLLKDGQWV</u>
<u>DVPPMRHSIVVNLGDQIEVITNGKYKSVLHRVVAQTDGNRMSIASFYNPGSD</u>
AAIYPAPALMESKAEEASKAAYPKFVFEDYMKLYAALKFQAKEPRFQAMKV
MESSPNLEPIATA

FIGURE 23: Amino acid sequence of SEQ ID NO: 265. The conserved 2OG-Fe(II) oxygenase superfamily domain is underlined.

MEIPMIDLSELDGKNRSKTMALLHHACEKWGCFKIKNHGVDPELMEKVKHF
VNTHYEENLKASFYESETAKCLENANGATSDLDWECTFFIWHRPKSNIEDFP
NLSNDLRKTMDEYIAQLVKLAENLSELMCENLGLGKDHIKRAFSGKDG<u>PSVG</u>
<u>TKVAKYPECPYPEKVRGLREHTDAGGIILLLQDDQVPGLEFLHDDQWVPIPP</u>
<u>STNDTIFVNTGDQLEVLSNGRYKSVWHRVMAVESGSRLSVATFYNPA</u>GDAII
SPAPKLLYPEKYTFGEYLKLYATTKFQEKEPRFESMKSVMSNGYNGVV

FIGURE 24: Amino acid sequence of SEQ ID NO: 269. The conserved 2OG-Fe(II) oxygenase superfamily domain is underlined.

MEIFPVINLEKLNGEERGVTMEMIRDACENWGFFELVNHGISHELMDTVERL
TKGHYKECMERKFKEMVASKGLEAVQSEIGDIDWESTFFLRHLPVSNISEVP
DLKEDYRKVMREFALEIEKLAEQLLDLLCENLGLEKGYLKKVFYGSKG<u>PTFG</u>
<u>TKVSNYPPCPNPELFKGLRAHTDAGGIILLFQDDKVGGLQLLKDGKWIDVPP</u>
<u>LRHSIVINLGDQLEVITNGKYKSVEHRVIAQSDGNRMSIASFYNP</u>GSDAVICP
APALLKKEAGEEGQAYPKFVFEDYMKLYARLKFQAKEPRFEAMKATESTIAR
GPIATA

FIGURE 25: Amino acid sequence of SEQ ID NO: 273. The conserved 2OG-Fe(II) oxygenase superfamily domain is underlined.

MQILPSPEESITCSGPHYDRAKEAKEFDETKAGVKGLIDSGMAKVPRLFIHPP
QNLRDLSSDTEGSATDLKVPIIDMMGCQDSQLRRDVVDDLRRASETWGFFQ
IINHGIPVDVMDGVLEAVKQFHEQPEGVKGEWYSRDDARKFRYYSNGDLFW
SKAATWKDTLLFDFPFGEPDREAVPLLFRETVFEYEKHVEKLKGSLSELLSE
ALGLDSGYLGDIECMDSKRIVSHYYPTCPEPELTLGTINHSDATYLTLLLQNH
NGGLQVRHQNQWVDVSPVPGAILVIIGDFMQLVSNDKFKSVEHRVLARRAG
PRVSVLCFLFPGETRKSKPYGPIKELLDENNPPMYRETSFTEYFGYYLSSGN
GLNGESVLPHFRVSEPK

FIGURE 26: Amino acid sequence of SEQ ID NO: 278. The conserved 2OG-Fe(II) oxygenase superfamily domain is underlined.

```
MTGTMIGVTNANEQQALDRAQEVRQFEDSNLGVKGLLDSGLSTLPPMFIHP
PDLLSSLKPVVGLKTDSIPIIDLSGSNSDRRPSVIEEVARAAREFGFFQIVNHG
VPTEVLGQTIAAVKAFHEQPAEVKARIYRRESETGVAFFASSVDLLHSNVAC
WRDSLRIRSGPVLPDEEEIPEVCRNEVMEWNQQTQHLGVLLMGLLSEGLGL
SPSKLQDMTCVEKRNMLGHYYPYCPQPDLTVGLKPHTDKGVITVLLQDQVG
GLQVKHGEAWLDVTPSPGVLIVNIGDLLQIMSNDEYKSVEHRVLANPGPEPR
LSVAVFYYPLECENQIGPIPELVSPEKPAAFRQFKLGEYLKRFQTEVLDGKTL
KNHFKT
```

FIGURE 27: Amino acid sequence of SEQ ID NO: 316. The conserved 2OG-Fe(II) oxygenase superfamily domain is underlined.

MAVPVIDMKKMLNGEEREVTMAKIQNACQEWGFFQLLNHGIPHALLDRVKE
LFKEHYKNSMDAEFQKSEIVGMLESAVSQGKNFGTTKIDDDWETGFFLQDE
TYDTVSPPLPTNLKETMKEFSEEVKILAERILDIICENLGLEKGYLKEAIAGGN
GDGKAPFFGIKMAHYPPCPRPELVDGLRPHLDAGGVILLLQDDEVGGLQVL
KDGTWFDVEPIRHAIVIDIGDQLEVMTNGKCKSMWHRVLSKKDANRMSVAA
FYNPSTNAEVFPAPQLIMKATEQNGNENDNNNMNAQSGYSYPKFVSKDYM
KVYGEQKFLEREPRFEAMRALCSLK

FIGURE 28: Amino acid sequence of SEQ ID NO: 317. The conserved 2OG-Fe(II) oxygenase superfamily domain is underlined.

MPAKNGASLSSPFNIFFMSITGTAMKKMLNGEEREVTMAKIQNACQEWGFF
QLLNHGIPHALLDRVKELFKEHYKNSMDAEFQKSEIVGMLESATKIDDDWET
GFFLQDETYDTVSPPLPTNLKETMKEFSEEVKILAERILDIICENLGLEKGYLK
EAIAGGNGDGKA<u>PFFGIKMAHYPPCPRPELVDGLRPHLDAGGVILLLQDDEV
GGLQVLKDGTWFDVEPIRHAIVIDIGDQLEVMTNGKCKSMWHRVLSKTDAN
RMSVAAFYNP</u>STNAEVFPAPQLILKATEQNGNGNDNNNMNAQSGYSYPKF
VSKDYMKVYGEQKFLEREPRFEAMRALCSLK

FIGURE 29: Amino acid sequence of SEQ ID NO: 355. The conserved 2OG-Fe(II) oxygenase superfamily domain is underlined.

MAVPVIDIKKLLDGEEREMTMDQIHKACQEWGFFQLVNHGIPYSLLDRVKVL
FKEHYKNSMDAQFQDSAVVQMLESSNSQGMNLSATKIDADWETGFFLPLS
SHKTETVTPPLPANFRETMEEFAEEVKGLAERLLEIMCENLGLEKVYLKEAL
AGGNGDNNS<u>PFFGIKMSHYPPCPRPDLIDGLRNHTDAGGLILLLQDDEIDGL
QVLMDGTWFDVQPIQHAIVIDIGDQLEVMTNGKYKSMWHRVLAKEDATRMS
VAAFYNPSS</u>DAEVYPASQLMSAEQNGSNNVNAESGYDYPKFVSADYMTVY
AAQKFLPKEPRFEAMRSVGHAVN

FIGURE 30: Amino acid sequence of SEQ ID NO: 372. The conserved 2OG-Fe(II) oxygenase superfamily domain is underlined.

MAIPVIEMGSLIGNDKERFMAEMGKACEEVGFFQLKGHGIPVELMERVKKVC
SEHYNHVREPKFKTESVPVKLLNKSLMEAELSSSEPKKVENVDWEDCIVLQ
YAQEDYPWPSDPSEFKETMMEFGKEITKLAESLLELLSEILGLEKGYLKRTLS
GGDGPDDK<u>AFFGTKISHYPPCPRPDLVEGLRAHTDAGGLILLFQDDEVGGL
QVLDNTGRWIDAPPMKDTLVIDIGDQLEAISNGRYRSAWHRVLATDSGNRM
SVASFYNPS</u>LDAVISPAPELLSQPKKGSELSLYPKFMFGDYMNVYAQQKFLP
KEPRFQAVAALQY

FIGURE 31: Amino acid sequence of SEQ ID NO: 390. The conserved 2OG-Fe(II) oxygenase superfamily domain is underlined.

MDALLKQFERLQRPIDLVQTLHETQVKQVPARYILPSEQRPSRPLQVQQSLP
VIDLAGLEDTDQRIKIVSQIAQASQEWGFFQIINHDIPVSLLETVKRVSQEFFD
LPLEERRKQCPVRPGVHMLEGYGRFFDISDDTVLDWVDTLVHYISPEWAKA
VEHWPKNPSTYRETYEKYGEEVMKVMEKLLGLLSQGLGLDPKYIQTLNKE<u>S
LLQVRINYYPPCPQPDMVNGFKPHSDVDMLTVLLDDGVDGLQVRKDEDWF
TVPSIPGALIINIGDLLQIVSNGKYKSAEHRAVANTKQSRMSMVMFLRP</u>QEDV
LIDTAPELIDEAHPSLYKAVKAGEYETEYNSKDFRGKDAVHTLRIEQA

FIGURE 32: Amino acid sequence of SEQ ID NO: 247. The conserved classes I and II aminotransferase family domain is underlined and the aminotransferases class-I pyridoxal-phosphate attachment site is in bold. The 1-aminocyclopropane-1-carboxylate synthase domain is in italics.

MSYVSSNRKPLLSRKATNDGHAEKSPYFDGWKAYDKDPFHPTQNPSGVIQ
MGLAEHQLCFDLVQEWLVSNPEASICTKKGVDKFRDIALFQDYHGLPAFRN
AVAKFMGRVRGDKVKFDPDRIVMSGGATGAHEMITFCLADPGDAFLVPTPY
YAGFDRDLCWRTEARLLPVVCHSSNNFKVTRKALEEAYAKAVEANISVKGLL
LTNPSNPLGTILDRDTLREAMSFINEKNIHLICDEIYAATVFRQPDFISIAEIIEE
DQEYNRNLVHIISLSKDMGFPGFRVGIVYSYNDAVVECGRRMSSFGLVSS
QTQYLIASMLSDDQFIGKFLLESAERLETRHKNFTDGLHQVGIKCLNGNAGL
FLWMDLRELLMESTVEAETALWRGIINEFKLNVSPGSSFHCSEPGWFRVCIA
NMNEETMKVALARIREFVRRNGDKLNRKEKCRQSDLRLRLSFRRMDDVLRS
PCIMSPHSPIPQSPLVRTRT

FIGURE 33: Amino acid sequence of SEQ ID NO: 346. The conserved N-terminal FAD linked oxidase family domain is underlined.

MKFPAPARNLLIVLIVFLERILTRCMVSDSSNHEPPSSCTATRISPASSGIISNT
KPADCSSLASLDLHGSISLPGTAITTEDFGGIYHHK<u>PLAIVHPASVEDIVKVVT
MVNASPNLTLAAMGNGHSINGQAQALNGLVLDMRSLKGIEIFQGSPTEGPY
VDACGDELWIDVLKATLRVGLAPRSWTDYLPLSVGGTLSNGGVSGQTFKFG
PQISNVLNLHVVSGKGESMTCYPETNQDLFYGALGGLGQFGIITKARIMLQR</u>
APHMVRWIRAVYADFEEFRADQELLISLPEEGTFDYVEGFVLTNNDDPINGW
PSVLLSPSNSSFDFKLIPQTAGPMLYCLEVALHYDHDEDFVTLNKRIESMLAP
LRFIKGLHFSFDLPYFDFLNRVHAAEVAARSSGIWDAPHPWLNLFVPKSKISA
FDAKVFREILKDGVGGPILVYPVTRNKWDSRMSAIIPEEDTFYLVALLRFSPP
YPSGPPIQSILAQNEQILHYCTTAGIDMKLYLPHYKTESDWKRHFGRKWQQF
LQRKSKYDPKAILAPGQRIFSRSTDSTAFTRLYSSS

FIGURE 34: Amino acid sequence of SEQ ID NO: 368. The conserved N-terminal FAD linked oxidase family domain is underlined.

MGPCNGRFSALILISMTPPPSRVGVLISLFIMSLLLCISAPCMHSPAAALIGLS
RSEKYNTDGQDPCRLSFLDTAAAAIDFGRIYHHNPAAILRPVSAEEIARFLRAI
YASRALATGYRQEYLTVAAKGAGHSIHGQAQAPDGLVIEMSSLRGVRIHVAD
RAGGYSYADVAAGELWVDLLAEAMKLGLAPRSWTDYLYLSVGGTLSNAGIS
GQTFRHGPQISNVLQLDIITGTGELVTCSPAENADLFYASMGGLGQFGIITRA
RIILEPAPQKVKWVRALYSDFEQFTRDQELLVSMDDGAASVDYLEGFVVVN
NEAMRSWSISFRTDTPLDDSVFNDAGTEILFCIEIAKYFTQSDDETADVDKVT
GRIISRLSFIPGLIYSVEVPYADFLNRVRVEELNLRSRGLWDVPHPWLNMFVP
RRQIQRFTTSLLRIMSPDTVKGPILVYPVKRSKWNTNMSAVIPEDKDEIFYAV
GVLRSADPLCLAGSSCLNDLLSQNQQIIDVSTNANEIGNDKTEPGMGAKQYL
AHHSQQWQWKNHFGSKWGIFLQRKARYDPLNILAPGQRILNRNHRE

FIGURE 35: Amino acid sequence of SEQ ID NO: 214. The conserved GAF family domain is underlined, the N-terminal of the histidine kinase A family domain is in bold, the ATP-binding region, ATPase-like family domain is in italics and the response regulator receiver family domain is in bold/underline.

MESCNCVEPQWPADELLMKYQYLSDFFIALAYFSIPLELIYFVKKSAVFPYR
WVLVQFGAFIVLCGATHLINLWTFAIHSRTVAYVMTIAKVLTAAVSCITALMLV
HIIPDLLSVKTRELFLKNKAAELDREMGLIRTQEETGRHVRMLTHEIRSTL<u>DR</u>
<u>HTILKTTLIELGRTLGLEECALWMPTRSGLELQLSYTLRQQQNPVGYTVPIHL</u>
<u>PVINRVFSSNRALKISPNSPVARIRPLAGKYIPGEVVAVRVPLLHLSNFQIND</u>
<u>WPELSTKRYALMVLMLPSDSARQWHVHELELVEVVADQVAVAL</u>SHAAILEE
SMRARDLLMEQNVALDLARREAETAIRARNDFLAVMNHEMRTPMHAIIALS
SLLQETELTPEQRLMVETIMKSSNLLATLINDVLDLSRLEDGSFQLNIATFNL
HAVFREVLNLIKPVASVKKLLITLNLAPDLPEYAV*GDEKRLMQVILNVVGNAV*
*KFSKEGGISITAFVAKAEYLREARTPEFLPLPSDNHFYLRVQVRDSGSGVNP*
*QDIPKLFTKFAHNQSLATRNSGGSGLGLAICKRFVTLMDGHIWIESEGIGKGC*
*TATFIVRL*GIPEKLNESKFPVLPRGSSNHVLANFSG<u>LKVLVMDDNGVGRAAT</u>
<u>KGLLLHLGCDVTTVSSGDELLHAVSQEHKVVLMDICTPGIDSYEVAVQIHRL</u>
<u>YSQHHERPLLVAITGSTDKVTKENCMRVGMDGVIQKPVSLDKMRNVLSEL</u>
<u>LECGH</u>QMSSLARV

FIGURE 36: Amino acid sequence of SEQ ID NO: 274. The conserved response regulator receiver family domain is underlined, the GAF family domain is in bold, the ATP-binding protein, ATPase-like family domain is in bold/italics and the N-terminal Histidine kinase A domain is in bold/underlined.

MLKKLASGIFISSLLITVSVADNGFPRCNCDDEGSLWSVESILECQRVSDFLIA
VAYFSIPIELLYFISCSNIPFKWVLFQFIAFIVLCGLTHLINGWTYAHHPFQLMV
ALTVFKILTALVSCATAITLITLIPLLLKVKVREFMLKKKAWDLGREVGIIMKQK
EAGLHVRMLTQEIRKSLDRHTILDTTLVELSKTLGLQNCA**VWMPNNGKTEM
NLTHERGRNYSGTYHIPIPITDPDVVSIKQSDQVHILRPDSELATASSVGPGE
SGPVAAIRMPMLRVSNFKGGTPELHPACYAILVLVLPGGEPRSWSNQELEII
KVVADQVAVALSHAAILEESQLMREKLEEQNRALQQEKRNAMMASQ<u>ARSS
FQKVMNDGLKRPMHTISGLLSIMQDESLNADQKIIGNAMARTSAVLANLIN
DVVNMSTKNS**</u>GRFPLEVRSFSMHDMIREAACLAKCLCIYKGFSFELDIDRSL
PNNVM***GDERRVFQVILHMIGNLLNDSNQGKLVTLRILREKASGSQGRYDR
GWVTWRSESTDRGVRIKFEVGISDDISLLERSVSTIQLGGRKYNSDGVEED
FSFSICKWLVQLMQGNIWVVPNTQGFAQSMTLVLR***FPLRESISVTISEPGPS
PDYTLSNSVFTG<u>LKVLLVDSDDANKAVTRKLLEKLGCKVSTASSGFECLGAL
RPSESSFQIVLLDLHMPSLDGFEVANKIRQFHSSTNWPVIVALTTSGDDIWE
RCLQVGINGVIRKPVLLHGMANELRRVLLQPSKTLL</u>

FIGURE 37: Amino acid sequence of SEQ ID NO: 349. The conserved response regulator receiver family domain is underlined,The GAF family domain is in bold,The ATP-binding protein, ATPase-like family domain is in bold/italics and the C-terminal bacterial sensor protein domain is underlined and in bold/italics.

MESCNCIDPPWSADDLLTKYQYISDFFIALAYFSIPLELIYFVKKSAVFPYRWV
LVQFGAFIVLCGATHMINLWTFHVHTKAVAMVMTISKILTAVVSCATALMLVHI
IPDLLSVKTRELFLKNKAAELDREMGIIRTQEETGRHVRMLTHEIRSTLDRHTI
LNTTLVELGRTLALEECALWMPTRTGLELQLSHTLRQQNPMTFTVPIQHPS
INQVFSTNRAVMISPNSPVAMIRPRTGKYMIGDVVAVRVPLLHLSNFQINDW
PEPSKRWYALMVLMLPSDSARRWHVHELELVEVVADQVAVALSHAAILEE
SMRARDLLMEQNVALEIARQEAETAIR*ARNDFLAVMNHEMRTPMHAIIALSS*
*LLQETELTPEQRSMVETILRSSNLLATLINDVLDLSKLEDG*SLELNIRIFNLRS
MFREVHNLVKPIASVKKLCVSMNLASDLPEYAA*GDDKRLMQTVLNVLGNAV*
*KFSKEGSVSVTVLLERPECLRDPRAEFYPVQGDRHFYLRVQVKDTGAGINP*
*PDIPKLFSKFVHSDTMTTRNY**GGTGLGLAICKRFVNLMEG**HIWLESEGLGK*
*GSTCIFIVKLGIPDPIHEMEHQYVFPIPSNSTRKDFPG*LKVLVTDDNGVNRMV
TRSLLARLGCDVTVVDSGHECLQAMSQAGQNFKVLFLDVCMPGMDGYEVA
IHIQEMFPNRHERPLLVALTGSADKATKEKCIKIGMDGVLLKPVSLEKMRSVL
VDLLEHGSVCDSIQRL

FIGURE 38: Amino acid sequence of SEQ ID NO: 314. The conserved ubiquitin-associated domain is in italics. The elongation factors Ts domain is underlined and the elongation factor Ts signature 2 is in bold/underline.

MAYSGRARRPISFLLKQLKTSHSYSSWTRCNGFNGQSMFQSNAISRCKAPS
FRPTAELGWVLGFSHSCRGYSAEVGST*EQVGLIKQLRERTSAPMKDVKAAL*
*VDCNWDLEAAYTELRKK*GIAGASKKGARI<u>AAEGILALAQDEKVAAVI</u><u>ELNCET</u>
<u>DFVAR</u><u>NEIFQYLAHSVAKSALTMEALPELLSESATLDLKLLGEMNIILDHPKLT</u>
<u>REITVQDAIMEVAAIMGENVKLRRGFALSSANGVVSSYLHTSPQPGLGRIAG</u>
<u>LLTLESENGGAPTEVLQRVGSNLAMHVVAARPLFLSKDHVATKTLEAERDIL</u>
<u>KTQAAASGKPQAAIEKMVEGQLRKFVEEIALLEQKFVMNDKVNVKSVLEDLS</u>
<u>KEVGQQIRVGSFLRVEVGE</u>GIHRQETSFASEVAAQVG

FIGURE 39: Amino acid sequence of SEQ ID NO: 213. No conserved domain identified MDPSKSRDSAESTRVIQFPNDVLERILSLIDSHRDRNAVSLVSKAWYNAERW
TRRHVFIGNCYAVSPQIVARRFPNIRSVMLKGKPRFSDFNLVPPNWGADVH
GWLAVFADQYPQLEELRLKRMTVTDESLKFLARKFHNFRVLSLLSCDGFST
DGLEAIATDCRHLTELDIQENGIDDISGNWLSCFPENFTSMEVLNFASLSSDV
NFDALERLVSQCKSLKILKVNKSITLEQLQRLLVRAPQLTELGTGSFLQELTA
HQSEELERAFIGCKYLHALSGLWEATTLYLPVLYPACTNLTFLNLSYAALQSE
ELAKLVAHCPRLQRLWVLDTVEDVGLEAVASSCPLLEELRVFPADPYDQDIN
RGVTESGFLAVSLGCRKLHYVLYFCRQMTNAAVARIVQNCPGFTHFRLCIM
KPGQPDYLTNEPMDEGFGAVVKTCTNLRRLGVSGLLTDLTFEYIGRYAKNLE
TLSVAFAGGSDLGMKSILVGCPKLRKLEIRDCPFGNEALLSGLEKYESMRSL
WMSACKVTLHGCKTLATQRPRLNVEVMKDEEIDDGQSYKVYVYRTVAGPR
TDAPSFVHTL FIGURE 40: Amino acid sequence of SEQ ID NO: 222. The conserved cyclin-like F-box family domain is underlined.

<u>MNYFPDEVIDHVFDFVTSNRDRNVISLVCKSWYRIERLSRQRVFIGN</u>CYAISP
ERLIARFPGVRSLTLKGKPHFADFNLVPPDWGGFVYPWIDALARSKVNLEEL
RLKRMVVTDDGLELISRSFVNFKSLVLVSCEGFTTDGLAAIAANCRFLRELDL
QENEVEDHRGQWLNCFPDSCTSLVSLNFACLKGDINLAALERLVARSPYLK
SLRLSRAVPLDTLQKILVRAPQLVDLGVGSFVHDPDSETYNKLVTAIEKCKS
MRSLSGFLEVSAYCLPAIYPICSGLTSLNLSYAPGIPGSELTKLIRHCRKLQRL
WILDCIGDKGLGVVASSCKELQELRVFPSDPYGVGNAAVTEEGLVAISRGCP
KLNSLLYFCQQMTNAALKIVAQNCPNFIRFRLCILEPTKPDSSTNQPLDEGFG
AIVQSCKGVRRLSLSGLLTDQVFNYIGTFAEQLEMLSIAFAGDNDKGMLYVL
NGCKKIRKLEIRDCPFGNIALLTDVGKYETMRSLWMSSCDITLGGCKTLAKK
MPRLNVEIINENNEMEDCIDDEQKVERMYLYRTLVGPRKDAPEHVWTL

FIGURE 41: Amino acid sequence of SEQ ID NO: 224. The conserved cyclin-like F-box family domain is underlined.

MSKVLRFTGGEDFYSGRSIYQSPKEVNLFLSLGNHVDVYFPPSKRSRISAPF
VFSEDLFEQKRQ<u>DTIEVLPDECLFEIFRRLPGGQERSACACVSKRWLNLLSN
ICPNERSSG</u>KSQNNLDPTCGGEEVSSEDDGFLSRSLEGKKATDIRLAAIAVG
TADRGGLGKLSIRGSKLSHVTSLGLGAIARSCPSLKALSLWHLPSVGDEGLL
EVANGCHQLEKLDLCQCPNITNKFLVAVARNCPNLTDISIESCSSIGNEGLAA
VGQFCQNLKSISIKNCPSVGDQGIVGLISRAGSALTKFKLQALNITDVSLAVIG
HYATAVTDLTLASLHNVTERGFWVMGNGHGLQRLRSLIVTACRGATDLGLE
SLGKGCPNLKQLCIRSSAFLSDGGLVSFMKSARSLESLQLEECHRITLSGLY
GLVVGCGDKLKSLALTNCWGFKDFDFGSPQVSPCKSLRSFSVRNCPGFGD
ACLVALGKICPHLQQVELSGLTGITDEGLLRLLECCEAGLVKVNLSGCINLTD
QVVSAMAKLHGRTLEVLILDGCTKVSDLGLLAIAENCQLLSDLDVSKCAISDF
GLMALARSSQLSLQVLSVSGCSLVSDKCLPALKKVGRTLLGLNLQHCTAIST
RSVDLLLEELWRCDILA

FIGURE 42: Amino acid sequence of SEQ ID NO: 228. No conserved domain identified

```
MEDRNVKRPDSPGLSDIVLTCVMPYIDDPKDRDAISLVCRRWYEIDALTRKH
VTIALCYTTSPERLRRRFRHLESLKLKGKPRAAMFNLIPENWGGYVTPWVTE
IAQSFDCLKSLHFRRMIVEDSNLEVLATSRGRVLQVLKLDKCSGFSTDGLLH
VGRLCKTLRTFFLEESTIIEKDGAWLHELAMNNTVLETLNFYMTELSSFSVQD
LQIIARNCRSLTSVKISDCEILDLVGFFQDAAALEEFGGGLFNEEPERYAALSF
PARLCRLGLTYISENEMPIVFPIASRLRMLDLLYAFLSTDDLCLLIQQCPILEVL
ETRNVIGDRGLEVLAHSCKRLKRLRIERGADEQGMGDEGGLVSQRGLMDLA
RGCLELEYLAVYVSDITNSSLECIGTYSKNLCDFRLVLLDREEKITDLPLDNG
VRAILRGCEKLRRFALYLRPGGLTDVGLGYIGQYSQNIRWMLLGYVGESDE
GLREFSRGCPSLQKLEMRGCCFSEQALADAVMRLTSLRYVWVQGYRGSDT
GRDILAMVRPFWNIELIPARRIAVANQNGENVLNEDPAHILAYYSLAGPRNDC
PDSVIPLAPARLLTL
```

FIGURE 43: Amino acid sequence of SEQ ID NO: 232. The conserved cyclin-like F-box family domain is underlined and the F-box protein interaction domain is in bold.

<u>MSGGSDLPEEILIQILLKLPVKSLVRFRCVSKSWDSLITHPSFVSLHLR</u>HAMA
GHDRSVILLRHYSLTQRKERNTLYLDGESFLEHQELEFPLKTHDTYYLAGSC
NGLLCFSDYIINNLQVILWNPSLRKCVQLPIPRFIDTDLTHTYVLGFGFDTRR
VDYKVVRLIYILGKNWSVIVPPEVEIYELKTNAWRGIQTAVPYVIPESSSQAF
VNGAIHWIGYNPADRRLKVASSPRSIVVLFDMQDEVFGEMELPKGGDYAN
RLNLSLAVHQDLICLLHCHPMEEDGHQLYGVCWVWVMKEYGAADSWTKL
FTINISEHGGIGRILGFRKKGDALLVTHNDELVSYDLRGQRISRLGLYGVARS
FEVIPYMDCLILV

FIGURE 44: Amino acid sequence of SEQ ID NO: 236. The conserved cyclin-like F-box family domain is underlined.

MGQVPSSASSSPEPSHRGGAISSSHRLDSLPSLEFVSSFEDEEDAAAADEG
AAAGY<u>DYTGDLPDECLAHVFHFLGTGDRKRCSVVCRRWRRVDGESRHRLS
LNAQADLLSSLPSVFSRF</u>DAVTKLALRCDRKSVSLGDEALVLISLRCRGLARL
KLRGCREVTDLGVAAFAENCRQLRKLSCGSCSFGARAINAVLDHCVNLEEL
SIKRLRGIHDGAEPIGPGAAAKSLRSICLKELINGQCFGPLLVGARKLSTLKLI
RCLGDWDNVLQTIGSSNPGLLEVHLERIQVSDGGLCGIANCKGIDSLHVVKV
PECSNLGLSSIAENCRQLRKLHIDGWRINRIGDEGLVEVAKQCLQLQELVLIG
VSVTHSSLAAIGSNCRKLERLAFCGSDTVGDAEIACIAAKCEALKKLCIKNCPI
TDVGIESLAQGCPNLVKIKVRKCRGVSGQVVELLKERRGSLVFNLDACGIEA
LDDIRGVQESVMEFPPVNTSDAPSSSNERSMLFRAKLGLFAGRNLVACTFR
RWSNGEHSTNGNL

FIGURE 45: Amino acid sequence of SEQ ID NO: 237. The conserved cyclin-like F-box family domain is underlined.

MAYS<u>FPEEVLEHVFSFIGSDRDRNAVSLVCKSWYEIERWCRRRVFVGNCYA</u>
VSPAVVRRFPEVRSVELKGKPHFADFNLVPEGWGGYVSPWITTLARAYP
WLEEIRLKRMVVTDESLELIARSFKNFKVLVLSSCEGFSTDGLAAVAANCRN
LRELDLRESEVEDMSGHWLSHFPDSYTSLVSLNISCLGSEVSFSALERLVSR
CPDLRSLRLNRTVPLDRLANLLRRPPQLAELGTGVYSAELRSDDFSNLVGAL
AGCRELRSLSGFWDVVPAYLPAVYPLCSGLTSLNLSYATIQSSELTKLISQC
HSLQRLWVLDYIEDSGLEALAACCKDLRELRVFPSEPFNREGNVSLTEQGL
VSVSEGCSKLQSVLYFCRQMSNAALLTIARNRPNMTRFRLCIIEPRCPDYITH
EPLDTGFGAIVQHCKDLQRLSLSGLLTDRVFEYIGTYAKKLEMLSVAFAGDS
DLGLHHVLSGCDSLRKLEIRDCPFGDKALLANAAKLETMRSLWMSSCSVSF
GACKLLGQKMPRLNVEVIDERGHPDSRPESCPVEKLYIYRTVAGPRFDMPD
FVWTMDEDSALRPS

FIGURE 46: Amino acid sequence of SEQ ID NO: 252. The conserved cyclin-like F-box family domain is underlined MEGEEEQKPAATKRRKPRSGAPSS<u>APINNLDDGCLMHIFSFLSPIPDRYNTA
LVCHRWCYLACHPRLWLRVDR</u>SVKDSSEPGVFPNIELAVSAARPGDTILIAA
GGSHVASNIQIKKPLCLIGGGELPDETMLLCSRGSDSALEFLSTCKLSNLTVK
AELGCCLLHRSGRLIIDGCILQCETDPLDYLSCPIVSTATGSKVVSSPNGCHG
DGVSVSRTRIEGGAKAVLTSGDLALQRVRVICARTSMFFWFDVECPS FIGURE 47: Amino acid sequence of SEQ ID NO: 253. The cyclin-like F-box domain is underlined MGQSSSSTAPALGGRGADPDPDPDDGHSAAKSKAVIWPVLGEAAAEEC
AAPDLS<u>LSISDLPDECLACVFQYLGSGDRARCSLVCRRWLAVEGQSRQRLA
LH</u>AQSELLEAVPALFARFDSVSKLALKCDRKALSIGDDALVLISLKCRNLTRL
KLRGCRALTDTGIAVFTSNCRGLRKLSCGSCAFGAKGLNAVIDHCASLEELS
VKRLRSPTEGAAAEPIGPGAAAASLKTICLKELYNGQGFGPLIIGSKNLRTLKL
VKCYGDWDTVLQVMVERVAKLVEIHLERIQVSDFGIASLSNCSDLEILHLLKT
PHCTNLGLISVAERCTLLRKLHIDGLKLNRIGDDGLIAVAKRCPNLRELVLIGV
NPTELSLDLLGSNCLTLERLAFCGSDTVGDAEIMCIAARCVALKKLCIKNCPV
SDEGMKALASGCPNLVKLKVKKCGGVTSEGAAWLRMRRGSLALNLDSSDQ
EQIDAFASDGGGEENHVEFPPVPSQTAGANIASSSGTSRSSSFKSRLGSLR
GKSLMACTFRRWSSGSKDS FIGURE 48: Amino acid sequence of SEQ ID NO: 256. The conserved cyclin-like F-box family domain is underlined and the F-box protein interaction domain is in bold.

<u>MAELAGDLPGELVTEILDRLPVESLLRCRSVSKRWRGIIDSREFVRSHL</u>ARSF
ESTANLTLFFRHSSSLYCIDLTSLLRHGGVAEMNYPLMCYSDQIRV**LGSCNG
LLCISNAADDVVVWNPATRKHKFLPYSAVEVRRSSVFSVCVYGFGYDERR
DDYVLLRLVQLVTEPIESEVSIYSLKDNAWRRLKDMPYSLVYPRKMGVFVC
GHLHWIMTRELVSDSANLLVAFDFRIEDFKVVDQPEGIDNKLDMDLSVLGG
CLCLSINGNHMGVHVWIMKEYGLRDSWTKLFSIPQSEVARPLGFVRPLAYA
SNGRQVLVRQDSKNLILYDLETK**GMERVDINGMPNSFEAEICLRTLVSVDD
YGGYTKKKQQEAEEIENRTKRDDFLSVGFKLVL

FIGURE 49: Amino acid sequence of SEQ ID NO: 259. The conserved cyclin-like F-box family domain is underlined and the F-box protein interaction domain is in bold.

MSSSSSSGGGGGGAKLPHDVAVEILKRLPARSLLRFRCVCRSWRSAIDDPR
FVALHWSHSALHASSRHLACLDCGDDAVQNRCSLFPNAPLALPPPPSQIEIP
FVAPPNRYALVGSCNGLICVSESSSDGTERALYFWNLFTRKHKAVRLPRPE
RMPPFSVGGAHVVLGFCFDAKSNDYRVVRIIRYLGIRRRRFRNKKPRVEVY
SFRTDSWKTLECEVPLLCDSAVFLNGNLHWYSFNGEGDGYGSIVLFNVAD
EVFDEIALPEGISPHFVLSVTVLNESLAVFFSHREACFVWVMKDYGVPESW
SKLYTFEVTEPVTGFDGFTWNGELLMEINCEERVSWNPITAQLSILPLSARY
KLVPVVESLVPP

FIGURE 50: Amino acid sequence of SEQ ID NO: 263. The conserved cyclin-like F-box domain is underlined MAGLSDDLITKILDRFPKESLIPFRCVSKQWRRLIDDRFFRKSLLYLVPMYSS
SLYRIGLRRLGDLVEIENPFESEQIVLLGSCRGFLCIYNEIDGQIAIWNPSTRS
CQLLPPADAEIAHRLGPPACVYGFGYDYWNDEFVLLRLVQTMEDPILSVSIY
RSRGSVWRRLQGIPPYSLVEPRTMGVFLRGRLHWIMRRDPMQNSAIVLVAF
DIHTENSVEVQQLNFIDNRLPMYLAILEGGLCLIINDERGGVSAWIASEYGSE
ESWARLFSIADYSMGRVLLQPLAYSQNGRQVLLLYRETLVWYDLDTGDVEN
INSMLSISNTPIVGDYLGSRRRRLQGAWRQLEGMSYSLGNACKRGIFLHGRL
HWIMTLQLVLNSTKVLVAFDIRSDKFMEVSELNFIDNRLNMDLTLLGGCLCLII
YGEQRGVHAWIMREYGLNRPWYMLFSMPGHSRPLLAYSQNGRQVLVAVG
GKTLVWYDRVWYDLHTGGVKKFGKRGMPSSYEAEIYLRTLVPVGKPPI FIGURE 51: Amino acid sequence of SEQ ID NO: 268. The conserved F-box protein interaction domain is underlined.

MSTLSEDDETEILLRLPVKSLLKFKSVCKPWNSLISSPYFAKTHLQISASSPRI
LLATNPPLSVSCESLHDDDRAGHEGTPLTQLRPPVEAPDGCRPRI<u>VGYCDG
LVCLEYDDHRIVVLWNPATGESRNIPNASCSYNRPTICGLGYDPSTDDYKILR
HCSVADAYGFPEYSVFDVFALKTGSWRRVHDKHDEFNYWPEAGTYANGFL
HWLVVGRDPWEHKKIVSFSMSKEKFEDALLALPEANEGTGFRVLGVAGECL</u>
LIYKSMAEVDTFMAWMMSDYGVRSSSSWMELCSVTLPNQTLNTYFYMRPL
CSTRAGKIAFSSIGTTRLSMILRNVMTKWFVKEDKLDFVVYVESFVSPHGAK
LQNQYVSRVKEPMERSDFIGDHSVFKEGETSYKKANSHLSSKRRKAS

FIGURE 52: Amino acid sequence of SEQ ID NO: 271.

MDPTKKPRESSSSTASAAAAEFPDEVLERVLALLASHKDRSAASLVSKAWY
HAERWSRTRVFIGNCYSVTPEIVAGRFPKIRSVTLKGKPRFSDFNLVPQNW
GADIRSWLTVFAERYPFLEELRLKRMTVTDESLKFLALKFPNFKALSLMSCD
GFSTDGLAAIATRCRNLTELDIQENGIDDISGDWLSCFPENFTSLEVLNFASL
NSDVDFDALERLVSRCNSLKVLKVNRTISLDQLQRLLVRAPRLTELGTGSFL
QELNAHQYSELERAFGGCKTLHTLSGLYEAMAPYLPVLYPACANLTFLNLND
AALQNEELAKLVVHCPCLQRLWVLDTVGDEGLGAVARSCPLLEELRVFPAN
PFDEEVNHGVSESGFLAISYGCRRLHYVLYFCRQMTNAAVATIVQNCPDFT
HFRLCIMNPGQPDYLTNEPMDEAFGAVVKRCTKLQRLAVSGLLTDQTFEYIG
TYAKNLETLSVAFAGSSDRGMQCVLRGCPKLRKLEIRDCPFGNAALLSGLE
KYESMRSLWMSACKVTMNGCAVLARERPRLNVEVMKDEESSDGQAYKVY
VYRTVAGPRRDAPPFVLTL

FIGURE 53: Amino acid sequence of SEQ ID NO: 284. The conserved cyclin-like F-box is underlined.

MSSSSSGGDGGGGPKLPHDVAVDILKRLPARSLLRFRCVCRSWRSAIDDPR
FVALHLSHSALHASSRHLACLDCGEDAVQNRCSLFPNAPLALPPPPLQIEIPF
VAPPNRYALVGSCNGLICVSESSSDGTERALYFWNLFTRKHKAVRLPRPER
MPPLSVGGAHVVLGFCFDAKSNDYRVVRIIRYLGIRRRRFRNKKPRVEVYSF
RTDSWKTLECEVPLLCDSAVFLNGNLHWYSFNGEGDGYGSIVLFNVADEVF
DEIALPEGISPHFVLSVAVLNDSLAVFFSDGEACFVWVMKDYGVPESWSKLY
TFEVTGPVTAFDGFTWNGELLMEINCEERVSWNPITAQLSILPLLARYELLPV
VESLVPP

FIGURE 54: Amino acid sequence of SEQ ID NO: 286. The conserved F-box protein interaction domain is underlined.

MAHLNQFVGRTANLCLCVQQNSRLPYLSGVPSVEDLKYRLMGPSDQIRV<u>LG
SCGRLCIIDVADEINVWDPSTRQSMPLPHSAVEIRRPSALPICVYGFGCDVR
NGAFKLLRLIQLATGQRRSEVSIYNMIDQNWRRLPEIAYNLVYPDKMGVFAY
GRLHLTVTPERLACSPAKLLLAFDCHTEEFEEVELPDNIDKKRDMVVAVLDG
RLCLSIDRIDMFADVWILRVYGSQESWAWVFSIPKYDDDRIPRFVWPLACSE
DHHHVLVRKDNKDVVWYDLHAR</u>YINRVDIRGMPSSFKDAYVM

FIGURE 55: Amino acid sequence of SEQ ID NO: 293. The conserved cyclin-like F-box family domain is underlined.

MKRASYGCISDEALECVMGHLEDPRDRGSVSLVCKKWYDVDAFTRKHVTV
AFCYSIHASDLTRRFTRLESLTVKGKPRAAMYNLLPHDWGGYAKPWIDQISF
TCLCLKALHLRRMIVTDDDLTTLVRGRGHMLQELKLEKCSGFSTRGLEEVAH
GCRSLKILMLDESQIEEESGDWLHELALNNSSLEVLDFYMTTLEMINTSDLEL
IVTNCPSLTSLKVGECDIVEMRGVLSKATALEEFGGGTFNNSEEHATETSMIT
FPPKLTSLLGLNFMIEAEMPAIFPRASALKRLDLQYTFLSTENHCQLAGLCPN
LEILEVRNVIGDKGLEVVANTCKKLKRLRVERGADDPTLEDEQDKEEHIADLP
LDNGVRALLRGCQKLSRFAFYIRPGGLTDTGLGYIGEYSTNVRWMLLGFVG
ETDQGILEFSKGCPKLERLEIRGCCFSESALAAAVLQLKSLKYIWVQGYNAT
VTGANLLAMARPYWNIEFSPALQSSDVFAEDMAEEKKQDQVAQLLAYYSLA
GRRTDHPESVIPLAPLFWNCHQVTVF

FIGURE 56: Amino acid sequence of SEQ ID NO: 294.

MKRASYGCISDGCISDEALECVMGHLEDPRDRGSVSLVCKKWYDVDAFTR
KHVTVAFCYSIHASDLTRRFTRLESLTVKGKPRAAMYNLLPHDWGGYAKPW
IDQISFTCLCLKALHLRRMIVTDDDLTTLVRGRGHMLQELKLEKCSGFSTRGL
EEVAHGCRSLKILMLDESQIEEESGDWLHELALNNSSLEVLDFYMTTLEMINT
SDLELIVTNCPSLTSLKVGECDIVEMRGVLSKATALEEFGGGTFNNSEEHAT
ETSMITFPPKLTSLLGLNFMIEAEMPAIFPRASALKRLDLQYTFLSTENHCQLA
GLCPNLEILEVRNVIGDKGLEVVANTCKKLKRLRVERGADDPTLEDEQGWIS
HKGLSLVAQGCPLLEYIAVYVSDICNSTLETFGQCCKNLKDFRLVLLDKEEHI
ADLPLDNGVRALLRGCQKLSRFAFYIRPGGLTDTGLGYIGEYSTNVRWMLL
GFVGETDQGILEFSKGCPKLERLEIRGCCFSESALAAAVLQLKSLKYIWVQG
YNATVTGANLLAMARPYWNIEFSPALQSSDVFAEDMAEEKKQDQVAQLLAY
YSLAGRRTDHPESVIPLAPLFWNCHQVTVF

FIGURE 57: Amino acid sequence of SEQ ID NO: 305.

MGQGASSSSVVHALKREENDVNLGRDYSLSLPDECLACIFCTLSSGDRQRC
SLVCKRWFLVEGSSRQRLSLDARLDISAAIPGLFSRFDHVTKLALRCDRRMV
SIKDEGLIKIGIHCKSLKKLKLKACRELSDVGIEDFAKLCTGLKKLSCGSCTFG
AKGMNAVLKYCVGLEELSVKRLRGLADGSVDVIGPGCAMLKSICLKELFNG
QYFGPLIAGSKNLRTLKLFRCSGDWDKLLEVITDHVSGLVEVHLERLQVSDR
GLMAVSRCAGLEVLHLVKTPECTNVGLAAIANNCKNLRKLHIDGWKTNRIGD
EGLIAVGKKCQNLQELVLIGLNLTATSLSPLASNCQVLERLALCGSETIGDTEI
SCIAAKCLSLKKLCIKGCPVSDDGIESLVSGCPKLVKVKVKKCRGVTWEGAE
RLRANRGSLAVNLDTPLPNPVVGPPSGAGAAEASAPSTSKSSIAKAKFSLFA
GRNLVACAFLRLSNGSDGDHKRVSANA

FIGURE 58: Amino acid sequence of SEQ ID NO: 323. No conserved domain

MDQDQSICRFAAQKGKGEIQSSSFPDEVLEHVLVFLSSQKDRNSVSLVCKA
WHRVEAWTRQQVFIGNCYAVSPQIMIKRFPKIKSVSLKGKPRFADFNLVPPN
WGAHLTPWVSAMATAYPLLERLYLKRMTITDYDLTLLANSFLYFKELVMVCC
DGFSTGGLASIASKCRQLTTLDLNEDEIHDNGEDWLACFPETLTSLRSLCFD
CLEGPVNFDALERLVARCPSLKKLRLNRNVSIVQLQRLIIKAPQLTHLGTGSF
FYEFQLEQVADLLAAFSNCKQLQCLSGFREVVPEYLPAVYPVCSNLTSLNFS
YAVIGSRELEGIVCHCRKLQLLWVLDSVGDKGLEAAATTCKDLRDLRVFPVD
AREDGEGCVSERGLVAISEGCPNLESILYFCQRMTNKAVVTMSHNCSKLAS
FRLCIMGRHQPDHLTGEPMDEGFGAIVRNCKSLTRLAVSGLLTDKAFQYFG
AYGERLETLSVAFAGESDLSMKYVLDGCKNLRKLEIRDSPFGDVALLSGLHH
YENMRFLWMSDCRLTLQGCTELAKKMPGLNVEIIRENECNDSLVEKLYAYR
TVAGPRKDMPSFVTIL

FIGURE 59: Amino acid sequence of SEQ ID NO: 336.

MMKKRGDSSSSFPDEVLEHVLLFVVSIKDRSAVSLVCKAWYRAEAWSRRKV
FIGNCYSVSPEILVRRFPKITGITLKGKPRFSDFNLVPPHWGADIHPWLLVIRG
AYPWLRELRLKRMIVTDESLELIARSFSDFRALSLTTCEGFSTDGLAVIATHC
RNLQELDLQESEVDDRGGYWLSCFPESCVSLVSLNFACLQSEVNFDALQRL
VARCISLRSLKLNKTLSLEQLKRLLVIAPQLMELGTGSFFQELSGPQFTTDLE
NAFKNCNKLRTLSGMWEVAPLYLPALYSVCSNLTFLNLSYAANIRSMELGRL
VSHCPQLRRLWVLDTVGDKGLETVSSNCKNLRELRVFPLDPFGQDRVGVT
EKGILKISQGCPNLSYVLYFCRQMTNAAIIEVAQNCPRLTHFRLCIMNPCQPD
HLTDEPMDEAFGAIVKICKGLQRLAISGLLTDKAFEYIGLYAKNLETLSVAFAG
SSDLGMECVLRGCPKLRKLEIRDSPFGNAALLSGLEQYESMRSLWMSSCKV
TMSGCRYLAQNKPRLNVEIIKENDEDDNDADKLYVYRTIAGPRRDAPNFVLT
L

FIGURE 60: Amino acid sequence of SEQ ID NO: 343.

```
MKRCEGCFEVGRLEALGDDILLQVLDNINETRDRNSWSLVCKQFYRLESAY
KRKIRLLRGEMLPRILKRYRAVEHLDLSLCPQISDQCLGFVAAAAGSSLRSID
LSRLVRFSHLGLSVLAKGCENLVEIDVSYCARFGDMEAAAVSSAKNLQTLKL
VRCQMVSDLGLSLIAVGCRKLQNLNLKWCVGVSDLGVELVAIKCKELRSLDV
SYLQITNKCIASITQLFYLETFVSVGCVCIDDEGLALLKNGCKSLQRLDVSKC
QSMSSTGIISLANGCIALQQLNLAYCIPVTNALLASFDKYDSLQSIRFDGCEIS
SSGLKSIGKSCKSLMELSLSKCTGVTDEGISALVGGCTGLKILDITCCRDLTD
VAITAVATSCGNLSCLKMESCALVTERSLYMLGDSCPFLEVLDLTDCSVSNT
GLKSISRCTGLTTLKLGLCENISNEGLTHIAAHCSNLQEIDLYRSVGIGDTGLA
ALASGCPKLRMVNLSYCIGITDHGLKSLAQLEKLYNLEIRGCFLVTSAGISAIA
SGCKRLVELDIKRCYRVDDMGMMTVVQCCINLRQINVSYCPISDAAFLALVN
LSCLQNVNLVHLRNVSLDAFAYLLLACESLKKIKLLKQLKSLLSSNLIRHVENK
GCRIRWVEKPLFI
```

FIGURE 61: Amino acid sequence of SEQ ID NO: 351.

MVVRRMSSFPDELLEHVLAFLSSHRDRNAVSLVCKSWFRIEAGSRQRVFIG
NCYAVSPAILIRRFPRIKSVALKGKPHFADFNMVPPGWGADIHPWLAAMAEA
YPWLEELRLKRMVITDESLQLLARSFPNFKVLVLTSCDGFSTDGLAAIAAHCR
HITELDLQESDIDDRGGNWLSCFPDSCTSLVSLNFACLTKEVNFEALERLVA
RCTSLRSLKLNRLVPLELLHRLLVRAPHLEDLGTGAFLHEPRTEQYSKLKVAL
QNCKRLQSLSGFWEVAPGYLPLVESLCSNLTSLNLSYATIQSAELTNLLGHC
HKLQRLWVLDYIEDKGLEVVASTCKDLQELRVFPLDPYGQGAVTEEGLVTIS
RGCPKLTSVLYFCCQMTNAALITVARNSPLLTCFRLCIFDPTSPDHLTKQPLD
EGFGTVVQSCKSLRRLSMSGLLTDKVFQVIGTYGKCLEMLSVAFAGDSDFG
MQCVLSGCINLRKLEVRDSPFGDLALLAGSEKYESMRSLWMSSCSVTVHG
CKELAAKMRNLNVEVIHDRDQFEDISTMTQPVDGLYVYRSVAGHRKDTPHFI
YTM

FIGURE 62: Amino acid sequence of SEQ ID NO: 360.

MRQEHSENPEEEEERVSFDLNSMCKFSSQSDTEPIETSFPDEVLEHVLVFLT
AHKDRNAVSLVCKSWYRVEAWTRHQVFIGNCYALSPGTMINRFPKIKSVTLK
GKPRFADFNLVPPNWGAHLHPWVLAMAPAYPWLEKLLLKRMTVTDEDLALL
ADSFPNFKDLVLLYCDGFSTKGLGIIASKCRQLRRLDLNEDDIVDSGVDWLS
CFPETTTTLECLSFECLEGPINIDALERLVARCLSLKELRLNRTISIVQLHRLML
RAPQLTHLGTGCFSYDFIPEQATVLQVAFNNCKSLQCLSGFREVVPEYLPTI
YSVCNNLLELNLSYAVMGSRELEQIVCNCPKLQRLWVLDSVEDAGLRAAAA
TCKDLRDLRVFPMDAREDGNGCVSDEGLVAISEGCPNLQSILYFCQRMTNA
AVVTMSKNCQNLTSFRLCIMGRHKPDHITHKPMDEGFGAIVMNCKKLTRLAV
SGLLTNKAFEYIGTYGESLETLSVAFAGENDLGMKYVLDGCRRLRKLEIRDS
PFGDTALLSGLHHYEQMRFLWMSDCKVSIQGCMELARKMPWLNVEIIRENS
YDDRLVEKLYVYRSVAGPRKDMPPIVITL

FIGURE 63: Amino acid sequence of SEQ ID NO: 363.

MGHAASVVIPPQETKQEDEDSQEGVDYTLNIPDECLAHVFHYLKPGDRKPC
SLVCKRWHHAEGQSRRRLSLDARAEIVPAIPSLFWRFNYVSRLALRGNRRTI
GINDDGLLLIGIHCKNLKNLKLRSCREITDIGMSRFAQLCGSLRKFSCGSCTF
GTPGINAITTHCKSLEELTVKRLRSAGEVPSEPVGPGAGNLKRICLKELYYG
QFFVPLIAGSKKLQTLKLSKCSGDWDTLLDIITQDVTSLVEVLLERLHVSDTG
LLAVSKLASLEILHLAKTPECSNTGLAAIANGCRKLRKLHVDGWRTNRIGDEG
LIEIARKCHYLKELVLIGVNPTITSLSMLASNCHVLERLALCGSATIGDAELSCI
AAKCYSLKKLCIKGCPVSDQGMESLISGCPMLVKVKVKRCRGVTSEGADLL
RANKGSLDVSLDTITSPSLNGLSTQASSSVPRASAISSAGKSTLSKARLTLIA
GGSFLACAFLKLSNGS

FIGURE 64: Amino acid sequence of SEQ ID NO: 366. No conserved domain

MALMMEFGDDAGIGEEWEDNESQRMEIDTGKGIETHFNDIPEVIMSNIFSAIK
DTRSRNRMALVCRKWHEMERATRVYLCIRGNISNNLYRLPMCFQSVTKLDL
SLCSPWGYPPLDFTTPHGNFIGHRLKQAFPRVNNIVIYVRSARNIEKLSSLWP
CLEHVKLVRWHRRAMDPESAVGLGMELKLLMQNCTALKSLDLSQFYCWTE
DIPLALQAEPHVSANLSSLNLLKLSAEGFRAQELAAISGACRNLEELLAVCVF
DPRYMDCVGDEALVVLARNCSRVRILHLVDATAFEALRGDPEDIFSSENAKI
TRQGLESMFWNLPLLEDLVLDISHNVADSGPALEFLSSHCKNIKSLKLGQFQ
GICKGPEPDGVALCTNLEALFIKNCSDLTDTGLAAIAAGCSRLGKLELQGCR
QITEAGLKFCTSRLSKTLVEVRVSCCKYLDTAATLRALEPICESVRKLHIDCIW
DKSILDQEIASPSRRLNPVGSSAISTREIASYGMGKNHLVSAGDCNVNRWDQ
NPESAWGPSLQLAPPQFCPDLNCANFDFGSSPSDVPMTNWGLDLNLTASS
CSGPLESSEERGCLPIENFFEEHEKPNSLGSDRYVPSDGVMFRGMDVNGK
APQMERLCHSNTGTVSDSSSTEFVDFLGINDKHQEWQKLGADINYGMEVM
VNSSQIWGVTGEASKRTSSANLEGEQSWTEIPNQYSYSDSSSHIRSITWKNL
QFLSLWIPVGELLSPLAAMGLKVCPLLEEISIQVEGDCRLCPKPRERACGLSS
LACYPSLSKLELNCGEVIGFALSAPAGKMDLSLWERWYLNGLRELHLSELNY
WPPQDKDMNRRGLSLPAAGLLSECAALRKLFVHGTCHEHFMMMFIRIPDLR
DIQLREDYYPAHEDDTSTEMRTDSCRRFEEALASRGFTD

FIGURE 65: Amino acid sequence of SEQ ID NO: 369.

MDQDQSICRFAAQKGKGEIQSSSFPDEVLEHVLVFLSSQKDRNSVSLVCKA
WHRVEAWTRQQVFIGNCYAVSPQIMIKRFPKIKSVSLKGKPRFADFNLVPPN
WGAHLTPWVSAMATAYPLLERLYLKRMTITDYDLTLLANSFLYFKELVMVCC
DGFSTGGLASIASKCRQLTTLDLNEDEIHDNGEDWLACFPETLTSLRSLCFD
CLEGPVNFDALERLVARCPSLKKLRLNRNVSIVQLQRLIIKAPQLTHLGTGSF
FYEFQLEQVADLLAAFSNCKQLQCLSGFREVVPEYLPAVYPVCSNLTSLNFS
YAVIGSRELEGIVCHCRKLQLLWVLDSVGDKGLEAAATTCKDLRDLRVFPVD
AREDGEGCVSERGLVAISEGCPNLESILYFCQRMTNKAVVTMSHNCSKLAS
FRLCIMGRHQPDHLTGEPMDEGFGAIVRNCKSLTRLAVSGLLTDKAFQYFG
AYGERLETLSVAFAGESDLSMKYVLDGCKNLRKLEIRDSPFGDVALLSGLHH
YENMRFLWMSDCRLTLQGCTELAKKMPGLNVEIIRENECNDSLVEKLYAYR
TVAGPRKDMPSFVTIL

FIGURE 66: Amino acid sequence of SEQ ID NO: 373.

MMEALPDQVVWEVLDRIKETRDRNTAALLCKRFYQIEKNQREYLRVGCGLS
PAIEALSALCMRFPNLVRVEIGYSGWMSKLGKQLDNEGLKILSQHCPNLTDL
TLSFCTFITDGGLGYLGSCTGLKALRLNFTPGITGCGILSVVVGCKKLSTLHLT
RCLNVSSVEWLEYLGRLESLEDLAINNCRAIGEGDLAKLGYGWRNLKRLQF
EVDANYRYMKVYGRLAVERWQKQWVACEALEDLSLVNCLISPGRGLACVL
RKCQALQNLHLDMCVGVRDDDLISLAQQCPKLKTLSLRVPSDFSVPILMSNP
LRLTDESLKAIAQNCSELESVSISFSDGDFPSSSSFSLAGIVSLIEACPIRVLVL
DHVYSFNDSGMEALCAAHFLEILELIQCQEVTDEGLQLVKHFPCLSVMRLCR
CLGLTDIGLKPLVASHKLQKLKVEDCPQISEKGTQGAAKVVSYKQDLSWIY

FIGURE 67: Amino acid sequence of SEQ ID NO: 380.

MGEFKKWKRCNSLPSPINSLDDGCLMRIFSFLSPLPDRYSAARVCSRWRHL
ASDPRMWLRVEKSCNALAESGIFSTIEDAVVAARPGDTILIATGVVHMACNIQ
IVKPICLVGGSSPDETVLVCPRGFDSALEFLSTGKVANLTIKAELGSCLLHR
NGRLTVEGCVLQCEEHPLEHLCCPIVSTADALAPPSTLSSVMKGGSSMSVIH
TRIKGGAKAVLTNGSLTLQQVRVIYSPTALFFWFNVSQKSLTDIDLPPFICKA

FIGURE 68: Amino acid sequence of SEQ ID NO: 385.

MQRPSKTSVGYAIPDEVLKCVMGYLEEPCDRSAVSLVCKRWNRVDALTRK
HVTIAFCYTISPSDLGARFPELESLKLKGKPRASMFNLIPQDWGGYAEPWIN
EISQTLLCLKALHLRRMIVTDEDLRALARARGHILQVLKLEKCSGFSTLGLLEV
ARSCRSLRVLFLEESTIEDEGGEWLHELALHNSSLEVLNFYMTGLENVNVND
LEMIATNCRSLTSFKISECDILDLRNVFKKATALEEFGGGSFSSSEEQAVEPNI
YEMVKFPTNLMSLSGLNYMSETELPVVFPRASSLKKLDLQYTLLSTENYCQL
LQSCINIEILEVTNAIGDRGLEVAAENCKKLRRLRVERGEDEAGLEGQQNFVS
HKGLSVIAQGCPNLEYIAVYVSDMTNSALESVGKFCKNLRDFRLVLLDKKEQ
VTDLPLDNGVMALLLGCQKLKRFGFYLRPGGLTDIGLGYIGKFSSNVRWMLL
GYVGETDFGLLEFSKGCPNLEKLELRGCCFSEYALSVAALSLRSLKYIWVQG
YNATPSGFDLLAMERPFWNIEFTPASQVTVDGFNLEEEITEKPAQILAYYSLA
GRRTDHPDSVIPLSLSSWNRQLQHVYEYSLFHAYEY

FIGURE 69: Amino acid sequence of SEQ ID NO: 394.

MQRPSKTSVGYAIPDEVLKCVMGYLEEPCDRSAVSLVCKRWNRVDALTRK
HVTIAFCYTISPSDLGARFPELESLKLKGKPRASMFNLIPQDWGGYAEPWIN
EISQTLLCLKALHLRRMIVTDEDLRALARARGHILQVLKLEKCSGFSTLGLLEV
ARSCRSLRVLFLEESTIEDEGGEWLHELALHNSSLEVLNFYMTGLENVNVND
LEMIATNCRSLTSFKISECDILDLRNVFKKATALEEFGGGSFSSSEEQAVEPNI
YEMVKFPTNLMSLSGLNYMSETELPVVFPRASSLKKLDLQYTLLSTENYCQL
LQSCINIEILEVTNAIGDRGLEVAAENCKKLRRLRVERGEDEAGLEGQQNFVS
HKGLSVIAQGCPNLEYIAVYVSDMTNSALESVGKFCKNLRDFRLVLLDKKEQ
VTDLPLDNGVMALLLGCQKLKRFGFYLRPGGLTDIGLGYIGKFSSNVRWMLL
GYVGETDFGLLEFSKGCPNLEKLELRGCCFSEYALSVAALSLRSLKYIWVQG
YNATPSGFDLLAMERPFWNIEFTPASQVTVDGFNLEEEITEKPAQILAYYSLA
GRRTDHPDSVIPLSLSSWNRQLQHVYEYSLFHAYEY

FIGURE 70: Amino acid sequence of SEQ ID NO: 262. No conserved doamin

MVSAAQAAGGSLSLSLSLRDREILTSVNSVASSFSLLGSGFIVLCYLLFKELR
KFSFKLVFYLALSDMLCSFFNIIGDPSIGFFCYAQGYTTHFFCVASFLWTTVIA
FTLHRTVVRHKTDVEDLEAMFHLYVWGTSVVMTIIRSIGNDHRHLGAWCWS
QTGRTGKAVHFITFYAPLWGAILYNGFSYFQVIRMLNNATRMAVGMSDRAY
HLDARPDMKALNRWGYYPLILIGSWTFGTINRIHDFIEPGHKIFWLSLLDVGT
AALMGLFNSIAYGLNSSVRRAIRERLDLVTWPETIRPWLPNSSRIRHQQQES
ELVSLKSQDPH

FIGURE 71: Amino acid sequence of SEQ ID NO: 272. The conserved C-like lanthionine synthetase family domain is underlined.

MSSSAVQFAAASRDGHENNGGGGGDSSGERLDPTAVLLPVDPGAPDLSLP
RETFLRAAL<u>SLKDQVVQATWREGGAADPTAYTGLLGTAFLCLRSYAATGDR
GDLLLSAEIVDACASAARASTRHVTFLCGKGGVFAVGAVVANLLGDHHKRD
FFLNLFLEVAQERALPVGPEEGGFGMSYDLLYGRAGFLWAALFLNKNLGEE
TVPNNVLMPIVDAVLAGGRAGASDIATCPLMYRWHGTRYLGAANGLAGILQ
VLLHFPLCEEYLEDVKGTLRYIMSKRFPHSGNYPSSEGNPRDKLVQWSHGA
TGMAITLCKASQVFPHDRDFRDAAIEAGEVVWKNGLVKKVGLADGISGNAY
AFLSLYRLTGERIYEDRARAFASFLYHDANKPVGTGHGHVADYAFSLYQGLA
GAACLWFDLVDAENSRFPGYEL</u>

FIGURE 72: Amino acid sequence of SEQ ID NO: 347.

MAGELTQAEKETLAAVNVGASALSFAGSAFIVLCYVLFRELRKFSFKLIFYLA
LSDMFCSLFNILGDPGKGFFCYAQGYTTHFVCVASFLWTTTIAFTLHRTVVR
HKTDVEELGAIFHLYVWGTSLVMTIIPSIGDGYGQAGAWCLVKTTSRATKVL
QFITFYAPLWGAILFNGFTYFQVSRMLNNATQMAAGMSDRQQQTDSRVDM
KAMNRWGYYPLILIGSWTFATVNRIHDFIEPQEKVFWLSFLDVGTAALMGLF
NSIAYGLNASVRRTLQQKIDLWWPEWFRKWLPGFIMLRDQAHESEMISLKIP
VEQ

FIGURE 73: Amino acid sequence of SEQ ID NO: 240. The conserved 2OG-Fe(II) oxygenase superfamily domain is underlined and the isopenicillin N synthase domain is in bold.

MAVDCLTSKTSPAMPPQHKDEAREDKKHLVFDASVIRHQPDIPKQFIWPDE
EKPCANAPDLAVPLIDLDGFLSKDPSASEEASRL**VGDACQKHGFFLVVNHG
VDAGLISDAHKYMDKFFGLPLSEKQRAQRKLGEHCGYASSFTGRFSSKLP
WKETLSFGYSAEKSSANVVEDYFKNTMGEEFEQSGRVYQDYCEAMSRLS
LGIMELLGMSLGIGRDHFREFFES**<u>NDSIMRLNYYPPCQKPDLTLGTGPHCD
PTSLTILHQDQVGGLQVFVDNEWRSISPNFNAFVVNIGDTFMALSNGLYKS
CLHRAVVN</u>SRTPRKSLAFFLCPRSDKVVRPPSELVAMSCPRAYPDFTWPVL
LEFTQKHYRADMNTLRAFTNWLQQRTSEPVR

FIGURE 74: Amino acid sequence of SEQ ID NO: 223. The conserved GRAS family domain is underlined.

MKRDHRDACSGGYGGGGGGEASGASKGEPPSSSSTHSLPGSGKAKMVM
WGEDDQDPSGGGGGGMDELLAVLGYKVRSSDMAEVAQKLEQLEMVMGS
AQEDGISHLSYDAVHYNPSDLSSWVQSMLFELNPPPPPQQVADAVLAAAES
SSTIAQHHRSHLGSRSQTQTRTLSQTSAPTQTQSQVIFNDDSEYDLRAIPGV
AAFPQGDSDFESAARKKMKTLNGGSNSLSSSSS<u>SSAAGAAPSESTRPVVLV</u>
<u>DTQETGVRLVHTLMACAEAVQQENLKLADALVKHIGLLAASQNGAMRKVAT</u>
<u>YFAEALARRIYRIYPNDGSLDSSCNDILQMHFYETCPYLKFAHFTANQAILEA</u>
<u>FATASRVHVIDFGLKQGMQWPALMQALALRPGGPPAFRLTGIGPPQPNNTD</u>
<u>ALQQVGWKLAQLADTIGVEFEFRGFVANSLADLEPAMLDIRPPEVETVAVNS</u>
<u>VFELHPLLARPGAIDKVLSSIKAMRPKIVTMVEQEANHNGPGFVDRFTEALH</u>
<u>YYSSLFDSLEGSGVAPPNQDLVMSEVYLGRQICNVVACEGPDRVERHETLV</u>
QWQARMGSAGFDPVHLGSNAFKQASMLLALFAGGEGYRVEENDGCLMLG
WHTRPLIATSAWQLAAATQ

FIGURE 75: Amino acid sequence of SEQ ID NO: 313. The conserved GRAS family domain is underlined.

MKRQHFQLQQQQQPQPNGHGRCCSTVPVHPNPVSMPGSGPPPQAPRTT
ATAPAAGAAAAGGGGSSGSCKGKEVVLKDTCKQGVGVDMELASMGYSVK
SSELEQVAHRLEQLEMMMCNGQEDGIISHLSSEAVHYNPSDLGGWIESMLS
ELHVPILPPTDQPFQFPQAAADQSSTVREASNSVPESSTSTSKGTRSVQNV
EQDQQYRLNGSGAGLFEPPEVLDRSEFQLHGYPGQGGVRDNGIDRMFGN
YGGLFSQVLDVSDLLVDDPDVLQEPPPQEASPSTLLLQSSSNSSLEVQSGQ
DRLEEDVTGREQKR<u>YRVCDPELSERTVVVMGADPHESGVRLVHTLMACAE
AVQRGNLAIAREMVKEVRILASAQGGAMSKVATYFAEALARRIYGFLPQDTL
RFNQNDPLSDFLQFHFYQTCPYLKFAHFIANQAILDAFSGHQQVHVIDFNLK
QGIQWPALIQALALRPGGPPAFRLTGIGPPQPDGTDALQEVGTRLHQFAESV
NVKFSFRGYVATSLADIKPWMLDARPELEAVAVNSILELHRLLEDPIPGRPSA
IDRVLASIWSLKPKILTVVEQEADHNRPVFLDRFTEALHYYSTVFDSLEARGL
QAQSEEQVMSEVYLGREICNIVACERSERVERHEPLLNWSVRLRNAGFWPI</u>
PLGSNAFKQASMLLSLFSGGEGYRVEENNGCLTLGWHSRPLIAASAWQRC

FIGURE 76: Amino acid sequence of SEQ ID NO: 374. The conserved GRAS family domain is underlined.

MDPMERAAKVLGSSPGHKNMMGCSSSGVKVEPEIDGLLANAGYTVKASDL
AHVAQRLEQLESIMGTVQDPGISHLASEAVHYNPSDLAGWIESMFGELNPG
ADMPVPFGDRGSLIDSSQVHKPIQDDPSLSAMDLALIHEYGLQFNGSQASN
PQGFSPDSDPSVRCNIFSGPPLRSGDSTTHTNFQARSFSAQSSDEG<u>SSLST
TRLGTAQQSIDNGAQESGIRVVHLLMGCAEAIQRNNLKVASNLVREIRMTVN
SAPCGAMGKVASHFVEALARRICGLNGAESNMSQADAQSEILYHHFYEVCP
YLKFAHFTANQAILEAFEGHGSVHVIDLNLMHGLQWPALIQALALRPGGPPL
LRLTAIGPRQPDGRDVLQEIGMKLAQFAESVNVEFDFRGVMADKLEDIKPW
MFQVKPGEVVAVNSVLQLHRLLYIDAPTGSSPIDVVLKSIGSLRPKIVTVVEH
EANHNGPVFLDRFVEALHYYSTMFDSLEACNVLPNSMEKFLAELYIQKEICNI
VACEGRYRIERHETLSHWRIRLGRAGFRPSHLGSNAFKQARMLLTLFSGEG
YTVEENNGSLTLGWHSRPLIAASAWQGS</u>

FIGURE 77: Amino acid sequence of SEQ ID NO: 279. The conserved 2OG-Fe(II) oxygenase superfamily domain is underlined.

MVVASPNPRRAEKIQAVELPAIDLSPSGRSAAPRLIVEACERYGFFKAVNHG
VPAEIVSRMDEASAGFFARPASEKRLAGPADPFGYGSKSIGFNGDVGEVEY
LLLESDPAFVSRRSASISDDPTRFSAAVNVYIEAVKDLACDILDLMAEGLGVR
DTSVFSRLIRAVD<u>GDSVFRINHYPQCAVLHGEVGFGEHSDPQILTVLRSNNV
GGLQISLEDGVWTPVPPDPAAFWINVGDLLQAMTNGRFSSVRHRAVTNPFR
SRTSIAFFGAP</u>PLDARIAPQRELVTPRRPRLYNPFTWAEYKKAAYSLRLGDK
RLDLFKACREDGGIDL

FIGURE 78: Amino acid sequence of SEQ ID NO: 288. The conserved 2OG-Fe(II) oxygenase superfamily domain is underlined and the isopenicillin N synthase domains are in bold.

MVVPSKLAIEQFSYVMNSNALSSHQIPVVDLSKPDSKSLIIKACEECGFFKVV
NHGVPLDFISRLEEEAVKFFSLPLPEKERAGPPDPFGYGNKMIGRNGDVGWI
EYLLLTTDPNFNYRKLPSAFNENPERFRSALSDYTSAVRYMACEILELMADG
LRIQQRNI<u>FSKLLMDEQSDSVFRLNHYPPCPELQSYVDRNMIGFGEHTDPQII</u>
<u>SVLRSNNTSGLQISMKDGTWVSVPPDQNSFFINVGDSLEVMTNGRFRSVR</u>
HRVLANTSKSRVSMIYFGGPPLSEKIAPLPCLMKGKESLYKEFTWFEYKKSA
YNTRLADNRLEHFQRVAAS

FIGURE 79: Amino acid sequence of SEQ ID NO: 370. The conserved 2OG-Fe(II) oxygenase superfamily domain is underlined.

MASTPVSSSASQPNLLRHYTPTVTDCSSSGSSIPVVDLSAQKTSVVQALVKA
CEDYGFFKVVNHGISQVLIDAMEAEAEKLFALPLSEKERAGPADPYGYGNR
SIGRNGDVGWIEYLLFRSDFQYVQQRYKAISPDNYINFCNTASKYISATKKLA
CDILELLAEGLGLPENIFSSFLTAEG<u>SDSAFRLNHYPPCPDPSNIIGFGEHTDP
QILTVLHSNDVGGLQVLSRDGKWVTVSPDPSSFSINIGDCMQVLTNGRFKSV
RHRAVTNTLRSRISMMFFGAPALDATIVTPSQLVDEDRPAQYMPFLWSQYK
KSIYCLKLGQTRGLLQKFQASMVGVGVA</u>

FIGURE 80: Amino acid sequence of SEQ ID NO: 202. The conserved aldehyde dehydrogenase domain is underlined and the aldehyde dehydrogenases glutamic acid active site is in bold.

MAEHRSYGNVLKTFDAHVPEIKFTKLFIDG<u>EFVDSVKGRTFETKDPRNGQV
VARVAEGDEEDVELAVIAARRAFDHGPWPRMPGYQRGRIMSKFADLIEENI
DELAALDTIDAGKLFSVGKARDIPNAAMLLRYYAGAVDKIHGEVLKMSRELH
GYTLREPVGVIGHIIPWNFPTGVFFMKVAPTLAAGCTMIVKPAEQTPLSALFY
AHLAKKAGVPDGVINVVTGFGPTAGAAISSHMDIDMVSFTGSTKVGHMVMQ
AAATSNLKQVSLELGGKSPLIVFDDVDLDTATNLALTGILYNKGEVCVAGSR
VYVQEAIYEEFEKKLVAKAKAWPVGDPFDPNVRQGPQVDKKQFEKILSYIEH
GKREGATLLIGGERLGTEGYYIQPTIFTDVNEDNVIVKDEIFGPVMSLMKFKT
MEEVIKRANDTRYGLAAGILTKNIDLANTVSRSIRAGMIWINCYLAVDNDCPY
GGYKMSGFGKDLGLDALHKYLHVKSIVTPIYNSPWL</u>

FIGURE 81: Amino acid sequence of SEQ ID NO: 203. The conserved aldehyde dehydrogenase domain is underlined and the aldehyde dehydrogenases glutamic acid active site is in bold.

MAENQSDANGSLKTYDEHVPDIKFTKLFING<u>EFVDSVKGRTFETIDPRNGEV
TARVAEGDKEDVDLAVKAARQAFDHGPWPRMPGYQRGRIMSKFADLIEENI
DELAALDTIDAGKIFSMGKAVDIPHAATCLRYYAGAADKIHGEVLKMSRELHG
YTLLEPVGVVGHIIPWNFPTSMFFMKVAPALAAGCTMIVKPAEQTPLSALYYA
HLAKKAGVPNGVINVVTGFGPTAGAAITSHMDIDMVNFTGSTKVGRIVMQTA
ATSNLKQVSLELGGKSPIMIFDDADLDTATDLALIGIVHNKGEICVAGSRVYV
QEGIYEEFEKKLVAKAKAWPVGDPFDPKVQQGPQVDKKQFEKILSYIEHGK
REGATLLTGGERLGTKGYYVQPTIFTNVKEDNVIVKDEIFGPVMSLMKFKTV
EEAIKRANDTRYGLAAGIVTKNIDVANTVSRSIRAGVIWINCYFAFDNDCPCG
GYKTSGFGRDLGLDALHKCLHVKSIVTPLYNSPWL</u>

FIGURE 82: Amino acid sequence of SEQ ID NO: 204. The conserved aldehyde dehydrogenase domain is underlined and the aldehyde dehydrogenases glutamic acid active site is in bold.

MREREMAENQSNANGSLKTYDAHVPEIKFTKLFINGKFVDSVKGRTLETIDP
RNGQATARVAEGDKEDVDLAVKAARQAFDHGPWPRMPGYQRGRIMSKFA
DLIEENIDELAALDTIDAGKLFSVGKAQDIPHAATMLRYYAGAADKIHGEVLK
MSRELHGYTLREPVGVIAHIIPWNFPTAVFFMKVAPALAAGCTMIVKPAEQTP
LSALFYAHLAKKAGIPDGVINIVTGFGRTAGAAISNHMDIDMVSFTGSTEVGRI
VMQAAATSNLKQVSLELGGKSPLIIFDDVDLDTATDLALTGILHNKGEICVAG
SRVYVQEGIYEEFKNKLVAKAKAWPVGDPFDPNVRHGPQVDKKQFEKILAYI
EHGKREGATLLTGGERLGTEGYYIQPTIFTNVKEDNMIVKDEIFGPIMSLMKF
KTTEEVIKRANDTRYGLAAGVLTKNIDMANTVSRSIRAGTIWINCYFAFDNDC
PLGGYKMSGFGRDFGLDALHKYLQVKSVVTPIYKSPWL

FIGURE 83: Amino acid sequence of SEQ ID NO: 258. The conserved aldehyde dehydrogenase domain is underlined,The aldehyde dehydrogenases cysteine active site is in italics and the aldehyde dehydrogenases glutamic acid active site is in bold.

MAARLFSSLLSRSSSAASSSSSSSSARALLSRARKPLLGREIKSYSTAAAIEE
PINPGVTVNHTQLFING<u>QYVDSASGKTFPTFDPRTGEVIAHVAEGEAEDINRA
VAAARKAFDEGPWPRMTAYERANVLFRFADLLEKHNDEIAALETWDNGKPY
EQAAKIELPMIVRQIRYYAGWADKIHGLTVPADGQYHVQTLHEPIGVAGQIIP
WNFPLLMYAWKVGPALATGNTVVLKTAEQTPLSALYATKLLHEAGLPPGVL
NVVSGFGPTAGAALSSHMDVDKLAFTGSTDTGKIVLELAAKSNLKPVT**LELG
GKSP**FIVCEDADVDKAVELAHFALF*FNQGQCCCAGSRTYVHESIYEEFVEKA
KARATVRSVGDPFKSGIEQGPQIDSEQFQKILRYIRSGVEGGATLETGGERF
GTKGHYIQPTVFSNVKDDMLIAKDEIFGPVQTILKFKDLKEVIQRANNSRYGL
AAGVFTQNIDTANTLTRALKVGTVWVNCFDVFDAAIPFGGYKMSGHGREKG
VYSLSNYLQVKAVVTSLKNPAWL</u>

FIGURE 84: Amino acid sequence of SEQ ID NO: 311. The conserved aldehyde dehydrogenase domain is underlined, The aldehyde dehydrogenases cysteine active site is in italics and the aldehyde dehydrogenases glutamic acid active site is in bold.

MTIARRCSSLIVRGVRSAGSRSSAVGSPALSKQASTKNSRIQRFGTAASALE
EPIAPPVQVKYTHLLIDG<u>QFVNAASGKTFPTFDPRTGDLIADVAEGDAEDVD
RAVKAARKAFDEGPWPKMTAYERSCIMYRFADLLEKHNDEIAALETWDNGK
PYEQSSLVEVPMAIRVFRYYAGWADKIHGLTIPADGPYHVQTLHEPIGVAGQI
IPWNFPLLLFSWKVAPALACGNTIVLKSAEQTSLTAIYAAKLFHEAGLPSGVL
NIIPGYGRTAGVAIAKHMDIDKLAFTGSTETGKAVLELASKSNLKRVT**LELGG
KSP**FIVCEDADVDQAVELAHSAL*FFN*QG*QCCCAAS*RTYVHESIYDEFVEKTK
ARCLSRVVGDPFKKGVEQGPQIDQMQFNKIMSYIKAGKESGAKLVTGGEQI
GTKGFYIMPTVFSEVQDDMPIATDEIFGPIQSILKFKDINEVIKRANGTDYGLA
AGVFTKSMDTANTLTRALRAGSIWINCFHIFDAGVPFGGYKMSGTGRQKGIY
GLQSYLQVKAVVTPL</u>KNPAWL

FIGURE 85: Amino acid sequence of SEQ ID NO: 312. The conserved aldehyde dehydrogenase domain is underlined, The aldehyde dehydrogenases cysteine active site is in italics and the aldehyde dehydrogenases glutamic acid active site is in bold.

MAAMRAGRGFSSLLTRAVRSAGTRSPAVGLAALSQEASIKNTGIRSLGTAAS
ALEEPIAPPVQVQYTQLLIDG<u>QFVNAASGRTFPTLDPRTGDLIVDVAEGDAE
DVDRAVKAARKAFDEGPWPKMTAYERSCIMLRFADLLEKHNDEIAALETWD
NGKPYEQAALVEVPMVVRLFRYYAGWADKIHGLTVPADGPYHCQTLHEPIG
VAGQIIPWNFPLLMFAWKVGPALACGNSIVLKSAEQTPLTALYAAKLFHEAG
LPPGVLNVISGYGPTAGAAIARHMDIDKVAFTGSTSTGQAVLELASKSNLKP
VTLELGGKSPFIVCKDADVDQAVELAHFAL*FFNQGQCCCAGSRTFVHESIH*
DEFVEKAKARCLSRVVGDPFRKGVEQGPQIDREQFNKVMGYIKSGRESGA
KLVTGGDQIGTKGFYIMPTIFSEVKDDMGIATDEIFGPVQSIIKFKTLDEVIKRA
NATRYGLAAGVFTKNIETANSLTRALRVGTVWVNCFDIFDAGIPFGGYKMSG
TGREKGIYSLNNYLQVKAVVSPL</u>KNPAWL

FIGURE 86: Amino acid sequence of SEQ ID NO: 364. The conserved aldehyde dehydrogenase domain is underlined,The aldehyde dehydrogenases cysteine active site is in italics and the aldehyde dehydrogenases glutamic acid active site is in bold.

MAGLDNGVVNGIVSVKFTKLFIDG<u>KFVDAISGKTFETLDPRTGDLITRVAEGD
KEDVDLAVKTAREAFDKGPWPRMSGYERGRLLNRYADLVEQYIDELAALET
LDNGQPLTLVRVIVTGCIQILRYYAGAADKIHGETLKMGGQYQAYTLHEPIGV
VGQIIPWNFPLFMFFMKISPALACGCTIVIKPAEQTPLTALYCAHLAKEAGLPP
GVLNVITGFGETAGAAISNHMDIDKVAFTGSTDIGRVIMVAAAHSNLKPVTLE
LGGKSPLIIMDDADIEEAVNLAHKAI*FFGSGQVCCAG*SRIYVQEGIHDKFVKR
VVERAKKQVVGDPFNPEVDHGPQIDKTQFEKILEYIEHGKREGAKLLTGGSR
VGEKGFYIEPTIFSHVQEDMKIGKEEIFGPVVSIFKFRTIEEAIELGNKTIYGLA
AGIVSKNIDTVNRLSRSIRAGVIWVNCYHVVFPDAPFGGYKMSGIGREQGLD
VLKNYLAVKCVITPLHDSPWL</u>

FIGURE 87: Amino acid sequence of SEQ ID NO: 212. The conserved nitrilase/cyanide hydratase family domain is underlined, the nitrilase/cyanide hydratase signatures 1 is in bold and the nitrilases / cyanide hydratase active site signature in bold/italics.

MALVPSDPINNGQSLPLIAEVNMSSDSSSAAAVVRATVVQASTVFYDTPATL
DKAERLLAEAASYGSQLVVFPEAFVGGYPRGSTFGVSIGNRTAKGKEEFRK
YHASAIDVPGPEVDRLAAMAGKYKVFLVMGVIERDGYTLYCTILFFDPQGHY
LGKHRKVMPTALERVIWGFGDGSTIPVFDTPIGKI*GAAICWENRMPLLR*TAM
YAKGVEIYCAPTADARDIWQASMTHIALEGGCFVLSANQFCRRKDYPPPPE
YVFAGTDDDLNPDSVVCAGGSVIISPSGNVLAGPNYDGEALISADLDLGEIAR
AKFDFDVVGHYSRPEVLSLIVRDHPSNPVTFASTSGKPEGPYK

FIGURE 88: Amino acid sequence of SEQ ID NO: 353. The conserved nitrilase/cyanide hydratase family domain is underlined,The nitrilase/cyanide hydratase signatures 1 is in bold and the Nitrilases / cyanide hydratase active site signature in italics.

MSIISIPEVEVEMGSASPNAR<u>TLRATVVQASTVFYDTPATLDKAERLIAEGAA</u>
<u>YGSQLLVFPEAFIGGYPRGSNFGAVIGNRTFKGREEFRKYHASAIDVPGPEV</u>
<u>ERISAAAAKYKVHVIMGVIERAGFTLYCTVLFFDSQGRFLGKHRKLMPTSLER</u>
<u>VIWGFGDGSTLPVYDTSIGRV*GALICWENRMPLLR*TALYGKGVELYCAPTAD</u>
<u>ARESWQASMLHIALEGGCFVLSANQFCRRKDYPPPPDYVFGGSEENMSPE</u>
<u>SVVCAGGSVIISPTGTVLAGPNFEGEALITADLDFGEIVRAKFDFDVVGHYAR</u>
<u>PEVL</u>KLTVNDYPLNPVTFSSGIAASEKKDSENV

FIGURE 89: Amino acid sequence of SEQ ID NO: 238. The conserved mago nashi protein family domain is underlined.

MAQYEEDNA<u>EFYVRYYVGHKGKFGHEFLEFEFRPDGKLRYANNSNYKNDI MIRKEVWLTPAVLRECRRIISESEIMKEDDSNWPEPDRVGRQELEIVMGNEH ISFTTSKIGSLVDVQTSKDPDGLRIFYYLVQDLKCFVFSLISLHFKIKPI</u>

FIGURE 90: Amino acid sequence of SEQ ID NO: 325. The conserved mago nashi protein domain is underlined.

MADDLG<u>EFYVRYYVGHKGKFGHEFLEFEFRPDGKLRYANNSNYKNDTMIRK
EVFLTQAVLRECRRIIAESEIMKEDDNNWPEPDRVGRQELEIVMGNEHISFTT
SKIGSLVDVQSSKDPEGLRIFYYLVQDLKCFVFSLIGLHFKIKPI</u>

FIGURE 91: Amino acid sequence of SEQ ID NO: 326. The conserved Mago nashi protein domain is underlined.

MPPTSDRIPAMADDLG<u>EFYVRYYVGHKGKFGHEFLEFEFRPDGKLRYANNS
NYKNDTMIRKEVFLTQAVLRECRRIIAESEIMKEDDNNWPEPDRVGRQELEI
VMGNEHISFTTSKIGSLVDVQSSKDPEGLRIFYYLVQDLKCFVFSLIGLHFKIK
PI</u>

FIGURE 92: Amino acid sequence of SEQ ID NO: 220. The conserved protein kinase family domain is underlined and the protein kinases ATP-binding region and serine/threonine protein kinases active-site signatures are in bold. The MAP kinase signature is in italics.

MADAAAQNGQFSDFPAVPTHGGQFIQYNIFGNHFEITAKY<u>RPPIMPIGRGAY GIVCSVLNSETNEMVAIKKIANA*FDNHMDAKRTLREIKLLRHLDHENVIGIRD VIPPPLRREFTDVYIAMELMDTDLHQIIRSNQGLSEEHCQYFLYQILRGLKYIH SANVIHRDLKPSNLLL*NANCDLKIIDFGLARPTAENEFMTEYVVTRWYRAPE LLLNSSDYTAAIDVWSVGCIFMELMNRKPLFPGRDHVHQMRLLVELLGTPAD ADLGFVRNEDARRYIRQLPQHPRQPLASVFPHVHPLAIDLVEKMLTFDPTKRI TVEEALAHPYL</u>TRLHDIADEPVCRQPFSFEFEQQPLGEEQMKDMIYQEAIAL NPEFA

FIGURE 93: Amino acid sequence of SEQ ID NO: 221. The conserved protein kinase family domain is underlined and the protein kinases ATP-binding region and serine/threonine protein kinases active-site signatures are in bold. The MAP kinase signature is in italics.

MATLVEPPNGVHSEGKHYYSMWQTLFEIDTK<u>YVPIKPIGRGAYGIVCSSVNR ETNEKVAIKKIHNA*FENRVDALRTLREIKLLRHLRHENVIGLKDVMMPIQRKS FKDVYLVYELMDTDLHQIIKSSQTLTNDHCQYFLFQLLRGLKYLHSAN*ILHRD LKPGNLLI*N*ANCDLKICDFGLARASNGKGQFMTEYVVTRWYRAPELLLCCD NYGTSIDVWSVGCIFAELLGRKPLFPGTECLNQLKLIINVLGSQREEDIEFIDN PKAKKFIKSVPYSPGTPLSRLYPNAHPLAIDLLQKMLIFDPSKRIGVTEALQHP YM</u>SPLYDPNTNPPAQVPIDLDVNEDLEEEMIREMMWKEMLHYHPEVAVGNL EVYS

FIGURE 94: Amino Acid sequence of 234. The conserved protein kinase family domain is underlined. The protein kinases ATP-binding region is in bold and the serine/threonine protein kinases active-site signature is in bold/italics. The MAP kinase signature is in italics.

MDGGAPQPADAVMSEAAPAPAQQQQHQPQQAQPQGIENIPATLSHGGRFI
QYNIFGNIFEVTAKYKPPIMPIGKGAYGIVCSALNSETNEHVAIKKANA*FDNK*
*IDAKRTLREIKLLRHMDHENVVAIRDIIPPPQREVFNDVYIAYELMDTDLHQIIR*
*SNQALSEEHCQYFLYQILRGLKYIHSAN***VLHRDLKPSN*LLL**NANCDLKICDF
GLARVTSETDFMTEYVVTRWYRAPELLLNSSDYTAAIDVWSVGCIFMELMD
RKPLFPGRDHVQQLRLLMELIGTPSEAELGFLNENAKKYIRQLPLYRRQSFT
EKFPHVHPLAIDLVEKMLTFDPRLRLTVEEALAHPYLNSLHDISDEPTCMNPF
NFDFEQHALTEEQMRELIYREALAFNPEYLQ

FIGURE 95: Amino acid sequence of SEQ ID NO: 235. The conserved protein kinase family domain is underlined. The protein kinases ATP-binding region is in bold and the serine/threonine protein kinases active-site signature is in bold/italics. The MAP kinase signature is in italics.

MESSSSGGASAEHSVRGIPTHGGRYVQYNVYGNLFEVSRKY<u>VPPIRPIGRG AYGLVCAAMNSETNEEVAIKKIGNA*FDNRIDAKRTLREIKLLCHMDHENVIGL KDIIRPPSRENFNDVYIVYELMDTDLHQIIRSNQPLTDDHCRYFLYQLLRGLKY VHSASVLHRDLKPSNLFLNSN*CDLKIGDFGLARTTSETDFMTEYVVTRWYR APELLLNCSEYTAAIDIWSVGCILGEIMTRQPLFPGKDYVHQLRLITELIGSPD DSSLGFLRSDNARRYVRQLPQYPRQQFSSRFQTMSPGAVDLLERMLVFDPI RRITVEEALCHPYL</u>APLHDINEEPICPTPFIYDFEQPSFTEENIKELIWRETLRF NPDPMH

FIGURE 96: Amino acid sequence of SEQ ID NO: 248. The conserved protein kinase family domain is underlined. The protein kinases ATP-binding region is in bold and the serine/threonine protein kinases active-site signature is in bold/italics. The MAP kinase signature is in italics.

MATLVEPPDGVRQRGKQYYSMWRTLFEVDAK<u>YVPIKIGRGAYGVVCSSIN RETHEKVAIKKIHNV*FENRIDALRTLRELKLLRHIKHENVIALKDVMLPVHSAS FREVYLVYELMDTDLHQLIKSPQPLSNEHCRFFIFQLLKGLKYLHSANVLHRD LKPGNLLV*NANCDLKICDFGLARTNQGDGQFMTEYVV*TRWYRAPELLLSCD NYGTSIDVWSVGCIFAEILGRKPLFPGTECLNQLRLIIDTLGSQGEEDIEFIDN RKARRYIKALPFSRGTHFSQLYPQADPLAVDLLQRMLVFDPRKRITVTEALQ HPYMAGLYDPRGNPPAQYPINLDIDDSMEQHMIREMMWNEILHYHPHQYAS LHG</u>

FIGURE 97: Amino acid sequence of SEQ ID NO: 299. The conserved eukaryotic protein kinase domain is underlined and the protein kinases ATP-binding region and serine/threonine protein kinases active-site are in bold and the MAP kinase signature is in italics.

METGAAAVDGHIQGILTHGGQYVQYNIFGNLFEVFSKYIPPIRPIGRGAYGIV CSAVNSETNEEVAIKKIGNA*FDNRIDAKRTLREIKLLCHMEHENIIAIKDIIRPP QREIFNDVYIVYELMDTDLYQIIRSTQPLTEDHCQYFLYQLLRGLKYIHSANIL* HRDLKPSNLLLNANCDLKICDFGLARTTSETDFMTEYVVTRWYRAPELLLNC SEYTAAIDIWSVGCIFMEILKREPLFPGKDYVQQLRLITELIGSPDDSDLGFLR SDNARRYIRQLPQFPKQPFSQKFPNMAPAAVDLLEKMLVFDPSKRITVQEAL SHPYLASLHDINDEPSCPTPFNFDFEQPSFTEEHIKELIWRESLNFNPDMMQ

FIGURE 98: Amino acid sequence of SEQ ID NO: 315. The conserved eukaryotic protein kinase domain is underlined and the protein kinases ATP-binding region and serine/threonine protein kinases active-site are in bold and the MAP kinase signature is in italics.

MEASAAAADGHIQGILTHGGRYVQYNIFGNLFEVSSKY<u>VPPIRLIGQGAYGIV CAAVNSETNEQVAIKKIGNS*FANRIDAKRTLREIKLLCHMDHENIIAIKDVIRPP QRENFKDVYIVYELMDTDLCQIIHSKQPLSVDHCQYFIYQLLRGLKYIHSANIL HRDLKPGNLFLNED*CDLKIGDFGLARTTSDTDSMTEYVVTRWYRAPELLLN CSEYTAAIDIWSVGCIFMEILKREPLFPGSNYVEQLKLITEFIGSPDDSDLGFL RSDNTRRYIRQLPQVPKQPFAQKFPNMDEDALDLLEKMLVFDPSKRITVEEA LSHRYL</u>ASLHGINEEPRCPAPFNFDFEQGTFTEEHIKELIWRESLNFNPDMM E

FIGURE 99: Amino acid sequence of SEQ ID NO: 324. The conserved eukaryotic protein kinase domain is underlined and the protein kinases ATP-binding region domain is in bold.

MQQDQRRKNSSEIEFFTEYGGASR<u>YKIQEVIGKGSYGVVCSAIDTHTGEKV AIKKITNIFEHLSDATRILREIKLLRLLRHPDIVEIKHIMLPPSQREFKDIYVVFEL MESDLHQVIKANDDLTPEHYQFFLYQLLRALKYIHTANVFHRDLKPKNVLAN ADCKLKICDFGLARVAFNDTPTAIFWTDYVATRWYRAPELCGSFFSKYTPAI DIWSIGCIFAEVLTGKPLFPGKNVVHQLDLMTDLLGTPSPETIARVRNEKARR YLNSMRKKQPVPFTQKFVGADHLALKLLERLLAFDPKDRPTAEEALADPYFR</u> GLAKVAREPVAQPITKMEFEFERRRVTKDDVRELIYREILEYHPQIMKEYLNG TDRTNFMYPSAVDQFKRQFAHLEEHYGKGGSVPPLERQHASLPRPCVVYS NSGGPSSEQASSGPSRDRALEVREEAPRYSREGEKQHQDRSSGNVKVPL HASHKVLQGSTAKPGKVIGPVLPCENGSIKEAYNPRRLIRNAGVAPSQCPAP IYSYPRRNSTAKTEVDDKREDGINQFNVSQHKTQYVGIGAARKVAALESRSS HLY

FIGURE 100: Amino acid sequence of SEQ ID NO: 334. The conserved eukaryotic protein kinase domain is underlined.

MGGTVVDSVRRWYQRRWSHSSSAHESGKEKQTVDSLSSSSVSPLPVETK
AVEGRGLKPVRVQLRSKMTGPDRSRKSSLETEFFTEYGEANRYQIQEVVGK
GSYGVVSSAIDTHTDIVEIKHIMLPPSRREFKDIYVVFELMESDLHQVIKANDD
LTPEHYQFFLYQLLRALKYIHTANVFHRDLKPKNILANADCKLKICDFGLARVS
FNDAPSAIFWTDYVATRWYRAPELCGSFFTKYTPAIDIWSIGCIFAEMLTGKA
LFPGKNVVHQLDIMTDLLGTPSTETLSRIRNEKARRYLSNMRKKQPTPFSQK
FPNVDPLALRLLERMLAFDPKDRPTAEEALADPYFNGLAKVEREPSTQPISK
LEFEFERRRLTKDDVRELIYREILEYHPQMLQEYLCGGNNATFMYPSAVDMF
KRQFAHLEEHYSKGENSTPLGRQHASLPRERVIEFRENPTKHSKDSEKQQE
RITASVTKATLQSPPRNQGIVIDSAVSLSNGPSRAVPDPRNLVKSASINASKC
TVVVNSCQRRNSTMKPGDEKKEDLSSESSAVTYNTDSMVAGLTSKIAAMSS
GVAHS

FIGURE 101: Amino acid sequence of SEQ ID NO: 342. The conserved eukaryotic protein kinase domain is underlined and the protein kinases ATP-binding region and serine/threonine protein kinases active-site signatures are in bold.

MAQTAQPALDPNIPGVLTHGGRFVQYNIYGNMFEVTAKY<u>VPPLFPIGRGAY GVVCSALNSETNEQVALKK</u>ISNAFDNLIDARRTLREIKLLRHMQHENVISIKDI MLPPQREAFDDVYIALELMDTDLHQIIRSNQALSEQHCQYFLYQILRGLKYIH SANVLHRDLKPSNLLLSANCDLKIADFGLARTTSETDFMTEYVVTRWYRAP ELLLNSPDYTAAIDVWSVGCIFMELMNRKPLFPGKDHVHQLRLITELTGTPTD ADLGFIRSENAKRLVQLLPQLPRQSLAEKFPHVHPSAIDICERMLTFDPNQRI TVEEALNHPYLGSLHDETDEPTCPVPFNFDFEQYALTEEQMRELIYMEALAF NPT

FIGURE 102: Amino acid sequence of SEQ ID NO: 344. The conserved protein kinase family domain is underlined. The protein kinases ATP-binding region is in bold and the serine/threonine protein kinases active-site signature is in bold/italics. The MAP kinase signature is in italics.

MEAAAAPVQSTDTLMSDAPQAAGSNPMDSIPAVLSHGGRFVQYNIFGNIFE
VTAKYKPPLL<u>PIGKGAYGIVCSAMNSETKEQVAIKKIANA_FDNRIDAKRTLREI_
_KLLRHMDHENVVAIRDIIPPPQREAFDDVYIAYELMDTDLHQIIRSNQGLSEE_
_HCQYFLYQILRGLKYIHSAN_VLHRDLKPSNLLLNANCDLKICDFGLARITSET
DFMTEYVVTRWYRAPELLLNSADYTAAIDVWSVGCIFMELMNRQPLFPGRD
HVHQLRLLTELIGTPTEADLGFVRSDNARRFIRQLPQYPRQSFTQKFPHVHA
LAIDLCEKMLTFDPNQRITVEEALAHPYL</u>ANLHDISDEPICAMPFSFDFEQHTL
TEDQMKELIYREALVFNPEYAQ

FIGURE 103: Amino acid sequence of SEQ ID NO: 356. The conserved eukaryotic protein kinase domain is underlined and the protein kinases ATP-binding region and serine/threonine protein kinases active-site signatures are in bold.

MATKVDPPNGVAAEGKHYYSMWRNTFEIDTK<u>YIPIKPIGKGAYGIVCSAKNT</u>
<u>ETNEKVAIKKIGNVFENRIDAMRTLREIKLLRQLAHDNIITLKDIMTPVGRSNF</u>
<u>RDVYLVYDLMDTDLHQIIKSSQALTDDHYQYFIYQLLRGLKYLHSANVLHRDL</u>
<u>KPSNLLLTANCDLKICDFGLARTNCETGQFMTEYVVTRWYRAPELLLSCDE</u>
<u>YGPSIDVWSVGCILAELLGRQPIFPGKDYINQLKLIINVIGSPAEDDLYFVQSQ</u>
<u>KACSYIKSLPHVPSASLQRLYPQANPTAIDLLDKMLVFDPYKRITVTEALEHP</u>
<u>YF</u>SALHDPRLEPSATAPFELDMPDEELRVQELREMVWKEMLYYHPEAANIL

FIGURE 104: Amino acid sequence of SEQ ID NO: 359. The conserved protein kinase domain is underlined and the protein kinases ATP-binding region and serine/threonine protein kinases active-site signatures are in bold.

MATRVNPPNGVFVEGKHYYSMWRNIFELDAK<u>YIPIKPIGKGAYGIVCSARNA</u>
<u>ETNEKIAIKKIINAFENQTDARRTLREIKLLRLFAHDNIIALKDIMTPVTRTNFND</u>
<u>VYLVYDLMDTDLHQIIKSSQVLTDDHCQYFIYQLLRGLKYLHSANVLHRDLKP</u>
<u>SNLLLNANCDLKICDFGLARTNCEKGQFMTEYVVTRWYRAPELLLSCEEYG</u>
<u>TSIDIWSVGCIFAELLGRKPIFPGKDYINQLKLIVNVLGSPDEDDLEFIESQKAR</u>
<u>SYIKSLPVTSHASVQRLYPRANPSAISLLDKMLAFDPRKRITVTEALEHPYFS</u>
ALHDPSLERSATAPFDLDMPEEELKEEELKEMFWNEMLHYHPEAANTS

FIGURE 105: Amino acid sequence of SEQ ID NO: 367. The conserved eukaryotic protein kinase domain is underlined and the protein kinases ATP-binding region is in bold.

MQQDQRRKAPTEVEFFTEYGEASR<u>YKIQEVIGKGSYGVVCSAIDTHTGEKV</u>
<u>AIKKINDIFEHISDATRILREIKLLRLLRHPDIVEIKHIMLPPSRREFKDIYVVFEL</u>
<u>MESDLHQVIKANDDLTPEHYQFFLYQLLRALKYIHTANVYHRDLKPKNVLAN</u>
<u>ADCKLKICDFGLARVAFNDMPTTIFWTDYVATRWYRAPELCGSFFSKYTPAI</u>
<u>DIWSIGCIFAEILTGKPLFPGKNVVHQLDLITDLFGTPPIEAISRVRNEKARRYL</u>
<u>SSMRKKQPVPLSQKFSTADPLALKLLERLLSFDPKDRPTAEEALADPYFKGL</u>
AKVEREPSAQQISKMEFEFERRRVTKEDVRELIFREILEYHPQMLKEYLNGS
DRSNFMYPSAVDQFKKQFSHLEEHYGKGAPVVPLERQHASLPRSSVVHSN
TMPPLPEKTISGPSRDRTSESRDESSRYIRETEKLQHDRSAGNALKAPLQPP
QKILQGGAAKPGKVVGPLPYENGSTKEVYDPRRLIRNAVLTTSQYAAPIYSY
PRRTSNTKIEPNEKEDAESTLMPPKAQYVGIGAARKVAAVQSASSRLY

FIGURE 106: Amino acid sequence of SEQ ID NO: 209. The conserved eukaryotic protein kinase domain is underlined and the serine/threonine protein kinases active-site signature is in bold.

MKKGGLNPILNLKLSLPPPDEDSIAKFLTQSGTFVDGDLLVNRDGVRVVQQT
EVEVPPLIKPTDNQLSLAD<u>IDTIKVIGKGNGGIVQLVQHKWTGQFFALKVIQM
KVEESARKQIAQELKINQSSQCPYVVVCYQSFYDNGTVSIILEYMDGGSLAD
FLRKVKTIPEPNLAVICKQVLKGLLYLHHEKHIIHRDLKPSNLLINHRGEVKITD
FGVSAIMASTSGQANTFVGTYNYMSPERIIGNNYGYKSDIWSLGLVLLECAT
GKFPYTPPDQQEGWTNFYELMEAIVDHPPPSAASDQFSSEFCSFISACVQQ
DPKKRWSANELMGHPFIS</u>MYEDLNVDLASYFTNAGSPLATF

FIGURE 107: Amino acid sequence of SEQ ID NO: 244. The conserved eukaryotic protein kinase domain is underlined and the serine/threonine protein kinases active-site signature is in bold.

MRSTKPLKPLKLAVPAPDAPIASFLTASGTFHDGDLLLNHKGLRLKSEEKES
CLSNGKELDLDFSLED<u>LETIKVIGKGSGGVVQLVRHKWVGKLFALKVIQMNIQ</u>
<u>EEIRKQIVQELKINQASQCPHVVICYHSFYHNGAFSLVLEYMDRGSLADVIRQ</u>
<u>VKTILEPYLAVVCKQVLQGLVYLHNERHVIHRDIKPSNLLV</u><u>NHRGEVKITDFG</u>
<u>VSAMLASSMGQRDTFVGTYNYMSPERISGSTYDYSSDIWSLGMVVLECAIG</u>
<u>RFPYMQSEDQQSWPSFYELLEAIVESPPPSAPADQFSPEFCSFVSSCIQKD</u>
<u>PQQRSSSLDLLSHAFI</u>KKFEDKDIDLGILVGSLEPPVSFPRC

FIGURE 108: Amino acid sequence of SEQ ID NO: 261. The conserved protein kinase domain is underlined.

MALVRERRQLNLRLPLTDLPNRRPLFPPPLSLPLPPSAAAAASATAAAGSGA
AATSLSDLESLGVLGHGNGGTVYKVRHRRTSAVYALKVVHAGCDATVRRQ
VLREMEILRRTDSPHVVRCHGIFEKPNGDIAILMENMDAGSLQTLLEASGTFS
EKQLAAVARHVLNGLHYLHSLKIIHRDIKPSNLLVNSAMEVKIADFGVSKIMC
RTLDACNSYVGTCAYMSPERFDPDSYGGNYDGYAGDIWSLGLTLLELYLGH
FPLLGPGQRPDWATLMCAICFGEPPKSPDGSSEEFRSFVECCLQKESSKR
WSVAELLNHPFIAGGKDPAGSL

FIGURE 109: Amino acid sequence of SEQ ID NO: 297. The conserved eukaryotic protein kinase domain is underlined and the serine/threonine protein kinases active-site signature is in bold.

MSSRERKARVGLKLPIPAREDAFAKPMPLPLPLPKPPNMNGACKLPCVPLE
EVTLEDLQKISTLGCGSSGKVYKVKHAKTGKIYALKIIQEKHELAVRKQIMRE
MEILRRANSPHIVQCYGIFDRGGEISFVLEYMDGGTLAQVLQAHKKIPEHYLA
EVARQVLKGLHYLHQNKIVHRDIKPSNLLINKRREVKIADFGVSTVLAHTLAQ
CNSFVGTCAYMSPERFDPDGYGGKYDGCSADIWSLGLSLLECALGRFPCLS
PGQRPDWPTLMVAICLGDPPSPPPDASPEFQSFIRCCLQKDALLRHTAHRLL
SHPFLKKYEQQSCDLAPLLQSLHL

FIGURE 110: Amino acid sequence of SEQ ID NO: 341. The conserved serine/threonine protein kinase domain is underlined, and the serine/threonine protein kinase active-site signature is in bold.

MENMRKKLGPLFNSGQSFRPDISVDSCTSYKVTAGGTLHLLSNSCGEYNIN
ELGLQKRTSAGIDEYDTNEKTYQCASHEMCIFGVIGRGASSVVQKAIHIPTHR
ILALKKINTFEKEKRHQLLNEIRTLCEAPHVKGLVEFHGAFYTPASGQISIALE
YMDGGSLRDLVQSKKRIPEPILSVITHEILHGLIFLHHVRHLVHRDIKPANLLIN
LNGEPKITDFGISVGLENTVAMCGTFVGTVTYMSPERIGNEYYSFPADIWSL
GLSIFECGTGEFPYNASKGPVNLMLQVIDDPSPSPSRDCFSEEFCSFVDVCL
QKDPTARPTAEQLLSHPFIKKYENAGVDLSAYVQSIFDPIDRLKDLADMLTVH
YYMLFDGTDDQWHHMKTMYRENSAFSYANQVAAGANDIFNTLSRIHSMLV
GDSPDERLVHVVENLQCCVYGQHGVVIRVSGSFVLGGQFIPTGGGVQVEG
VSQGPLLDIASQRMGTFNEQFIMEPGEQIGCYYIYKQELCIQQ

FIGURE 111: Amino acid sequence of SEQ ID NO: 358. The conserved eukaryotic protein kinase domain is underlined and the serine/threonine protein kinases active-site signatures is in bold.

MSGRRNPLLNIPIPARQQTQLYRLPLPPQSTSVSRDVSDLADL<u>ERIQILGHGS
EGNVYKVRHRRTSELYALKVIHGNHDETVRQQIIRQMEILKKTESPYVVKCH
GIFERGEEIHFVLEYMDGGSLEQRRSDTMSERFLAEVARQVLEGLKYLHRH
KIVHRDIKPSNLLINRRQEVKIADFGVSRILSQTLDPCNTYVGTCAYMSPERF
DPETYGGRYDGYAGDIWSLGLSLLECYTGHFPFLAAGQKADWPALMCAICY
GDPPAPPPTASAHFRSFITCCLHKDARNRWTAAQLLGHPFVL</u>SNPPQTPSIP
MQRLSI

FIGURE 112: Amino acid sequence of SEQ ID NO: 365. The conserved eukaryotic protein kinase domain is underlined and the serine/threonine protein kinases active-site signatures is in bold.

MRKKDLKKLKLAVPAPETPMSDFLTASGTFQDGDLLLNRQGLRLISQEDDES
PSPIEPLDNQFTLAD<u>LETVSVIGKGSGGVVQLVRHKWTGQFFALKAIQMSIQ</u>
<u>ESVRKQIVQELKINQASQCPNVVVCYHAFYNNGVISIVLEYMDCGSLADVIKR</u>
<u>VKTFTEPYLAVICKQVLKGLIYLHRDRHIIHRDIKPSNLLVNHKGEVKITDFGV</u>
<u>SATLANSMGQRDTFVGTYNYMSPERISGSTYGFSSDIWSLGLVVLECATGR</u>
<u>FTYLPPGQEEGWLNFYELLETIVEQPAPCASPDEFSPEFCSFISACVQKDPK</u>
<u>DRMSATDLLNHAF</u>IRKYEDQNVDLAALLSSLSSPV

FIGURE 113: Amino acid sequence of SEQ ID NO: 250. The conserved protein kinase family domain is underlined MADVAGLTEAAGSR<u>FSSLELIGRGSFGDVYKAFDKELNKEVAIKVIDLEESED</u>
<u>EIEDIQKEISVLSQCRSPYITEYYGSYLHQTKLWIIMEYMAGGSVADLLQSGP</u>
<u>PLDEMSIACILRDLLHAIEYLHTEGKIHRDIKAANILLSENGDVKVADFGVSAQ</u>
<u>LTRTISRRKTFVGTPFWMAPEVIQNSDGYNEKADIWSLGITAIEMAKGEPPLA</u>
<u>DLHPMRVLFIIPRENPPQLDEHFSRSIKEFVSLCLKKVPAERPSAKELLKHRFI</u>
RNARKSPRLLERIRERPKYPTVEDGETPMIGKGVVEGSDTVKIRRDIKGEET
VRASNQGRGGKNTGWDFSIGGVQGTGTVRTNLLPPQVRERKSENSHNQA
TPRRVADGGNSWLSASGNSPQAAEISLRKDARDLHYNNHHDDEDSSLSGS
GTVVVRTPRESQPSPLLRDQSTLSSSSYSSVEDASTTGTVVFRGQHDESDS
PRTPKSRLGIQERSSSASLEDSAANLAEAKAAMQGAFKRGNAREKRSVLGK
FNDGQENGNREQLTKSPDSSRNSYEYFDAHKVLPRSRQASDDEDIAKILSS
SAPLSVLLIPSLKETTGDDSDGPVVHAVSTSLTNLERMKPGSCEVLISKLLQR
LASSKESSLKDLQDLATHTFSKGKISPEKSGNANTEADNRKKQQNKEFNSN
ANLSPLARFLLSRWQGQVSRDLNPT FIGURE 114: Amino acid sequence of SEQ ID NO: 280. The conserved serine/threonine protein kinase domain is underlined.

MYRIQAGSAAAAGVEPGYCVETDPTGRY<u>ARFEEILGKGATKTVYKAIDEVLG
MEVAWNQVKLNDSFRSPDEYQRLISEVHLLSTLNHDSIMKFHTSWVDVDGT
AFNFITEMFTSGTLRNYRKKYPRLHIRAIKNWAVQILHGLVYLHSHDPPVIHR
DLKCDNLFVNGHLGQVKIGDLGLAAILHGSRAAHSIIGTPEFMAPELYDENYN
ELVDVYSFGMCVLEMLTCEYPYIECTNPAQIYKKVTSGKLPEAFYRIKDSKAR
KFIGKCLANVSCRVSARELLHDPFLLSDEGDRLPGLKFKMPEPFLNGRDVDN
LRARDNPLRTDMMITGKLNPEGDTIFLKVQIADRNSARNVYFPFDVLNDTPID</u>
VAKEMVKELEIMDWEAEEIADMIGGEISALVPNWTKQDMTDYNQENDDGFA
PPFLSFSSGSSSQASPSGFTAYRENEIASDYGCLQDVPDDMSSPSSIHSGT
YSHTSYFCPEDQEVNPGPSNPDQHLISRSNRHTRFCADDYQRPRQFKDRS
QTLQCQVLTGSDRDSSSVINRRMAGHRLSRNRSLVDVHSQLLHLSLLEEVS
KRRLSRTVGEVENIGFQAPFEISRNAPWIGGSSFISSSRNKKGHRIQNRRN

FIGURE 115: Amino acid sequence of SEQ ID NO: 330. The conserved protein kinase domain is underlined.

MTGVEYDASDKDREPFVEVDPTGRY<u>GRYEDVLGRGAMKTVYRAFDQEDGI
EVAWNKVSLQNLDDVSLERIYSEVRLLKSLRNGNIIMFYNAWLDRKTGHVNF
ITEVCTSGTLRQYRQKHRHVSMKAVKNWARQILDGLHYLHSHIPCIIHRDLN
CSNIFVNGNTGILKIGDLGLAAALENDHAAHTIIGTPEFMAPELYEEDYNELVD
VYSFGMCLLEMVTLEIPYSECRSVAQIYKKVSSGIRPAALEKVTNQEVRQFIE
KCLAVTSARPSAAELLKDPFL</u>SEVQSSS

FIGURE 116: Amino acid sequence of SEQ ID NO: 331. The conserved protein kinase domain is underlined and the serine/threonine protein kinases active-site signature is in bold.

MPYYVLQREVESEFLEVDPTGRY<u>GRYNDVLGKGASKTVYRAFDEIEGIEVA</u>
<u>WNQVKVNDILQSPEDLERLYSEVHLLKTLKHKNIIKFFSSWIDTTTRNINFITE</u>
<u>MFTSGTLRQYRQKHKRVDLRAVKNWARQILRGLLYLHSHDPPI</u>IHRDLKCD
NIFVNGNQGEVKIGDLGL<u>AAILRKSHSAHTVIGTPEFMAPELYDEEYNELVDI</u>
<u>YAFGMCLLEMLTFEYPYSECSNPAQIYKKVTSGKKPAALYKLKDPEVRQFVE</u>
<u>KCLVTVSRRLPARELLMDPFL</u>QTDEHGLEYSFSRLDFCKDDVGELGPLLRE
PNIEAFQNGAHKLLQSIHLVHPCSKNEISVHHENKKQQKVVPLPSYIREDSM
SHNMDFTVKGKKREDDTIFLRLRIADTEGRIRNIYFPFDVEEDTAMSVASEMV
AELDLADQDVTKIAEMIDEEIMALVPDWKAGVAIDDHHSFYDHYHSSNKTSE
TCWWNHNDHASSISSQSSLLEYLRSHYHVDNKSEIVPCTQVECAAMHGRFE
EVTFQFNATDFYSYVEEEAPTISSGSSDVLHHDWVNGEDPVSPISLISHGSGI
SNFEDPQTCLISSGTGNKEDVVPSKPAKPPETTGYVGNFEESWSNGLSEGF
SPVTDSNCLSSVPKPMFHPQSPSSVNILSDEDEDSTSRELRLLAVKHQKEL
MELQRKHEHSLLGIENELKNRTPLGTSLDMKNSSPGINFQDQKLNVNGQRE
QREDDSVRHGTTGRDKEFVAMKQLGSDARGTRLSSSPSHRLSPMEPAVSS
DLPGPSKLAMHSSTLPSVRPINRNIAPNQRLMKMHSFSGVDSQRSINSLAKE
VSRQKNYQTIGAFRTGNVDEKKHSLEGMRRFPSISQKSSSRNCKEGKTKIV

FIGURE 117: Amino acid sequence of SEQ ID NO: 357. The conserved eukaryotic protein kinase domain is underlined and the protein kinases ATP-binding region is in bold.

MGIELEMDRPQEEGWVRGAILGAGAYGTVSLGVSRSNGQLFAIKSAAGFS
VALENEYQILRCLDCPYIVRCLGHNYSFENGAEVHNLFLEYMPGGSLVDLLG
RFGGTLNETVIRAYTRGILRGLDYLHSQGIVHCDIKGKNILVDSNGVKLADFG
SAKRVDDEEKCEEAMQLRGTPQWMAPEVVNQVEQGPASDIWSLACTVLE
MATGRPPWSHVSSPLAAMYRIGCTEELPGLPGCLSPQIRDFLEKCFRRDPK
KRWSSAELLNHPFLKKDCSVIEAEEAIRGPGSPTSHLDFRNHIWDSYCSQTT
LIPSLSLPSPTRERNAEVNRSVEQCPRRSPRDRLMALAAACKFEKVANRPN
WITSLHGPWTVVKSSRSKSPTSDKPLLKSDISNGSSIQELPFTEERCSTSFKA
VNWKGLQPRGELDQCSQAMLSSAQSQHQPSSSTSSKTPHHNLFSLAETSN
LTGEAWESDGNSSQRIVGGD

FIGURE 118: Amino acid sequence of SEQ ID NO: 375. The conserved PAS family domains are underlined and the phytochromoe family domain I in bold with the Phytochrome chromophore attachment site signature in bold/italics. The GAF family domain is in italics, the ATP-binding protein, ATPase-like family domain is in bold/italics/underline and the N-terminal domain of the histidine kinase A family is in underlined italics.

MASNSRYTQSQSTGSNNRRSSTNTNTTTNKATAMAQYNADARLLQVFEQS
GESGKSFDYTRSVKSTTESVPEQQITAYLSRIQRGGRIQPFGCVLAVEETTF
RIIAYSENAVEMLDLAPQSVPSMEQPQQDVLTIGTDVRTLFTAASAHSLEKAA
VAQEISLMNPIWVHCKNSRKPFYAIVHRIDVGMVIDLEPLRTGDAFMSAAGA
VQSQKLAVRAISRLQSLPCG*DVGLLCDSVVENVRELIGYDRVMVYKFHEDE
HGEVVAEIRRSDLEPYLGLHYPATDIPQASRFLFMQNRVRMICDCMATPVKV
IQSEELMQPLCLVGSTL*RAPHGCHAQY*MANMGSIASLVMAVIINGNDEEGG
GSGRNSMKLWGLVVCHHTSPRAVPFPLRYACEFLMQALGLQLNMELQLAA
QLTEKHILKTQTLLCDMLLRDAPMGIVTQSPSIMDLVKCDGAALYYGGMCW
MLGVTPTEAQIKDIADWLLEHHGDSTGLSTDSLADAGYPGAASLGDAVCG
MASARITSKDFLFWFRSHTAKEMKWGGVKHHPDDKDDARRMHPRSSFKA
FLEVVKRRSLPWDNVEIDAIHSLQLILRGSFQDIDDSGTKTMVHSRLNDLRL
QGIDELSSVA*SEMVRLIETTTAPILAVDYNGLVNGWNAKVAELTGLPVGEAM
GMSLVQDLVFEESVERVEKMLHNALRGEEEKNVEMMLKTFGPQKEKEAVIL
VVNACSSRDFTDNIVGVCFVGQDVTSQKVVMDKFIRIQGDYRSIVQSPNPLI
PPIFASDEYACCSEWNAAMEKVTGWTHDEVIGKMLVGEIFGGCCRLKGQDA
V*TKFTIVLHSAIDGQEIEKFPFAFFDKQGKYVEALLTANKRTDADGRITGSFCF
LQIASSELQQALEVQRQQEKKCF*ARLKELAYIRQEIKNPLYGMMFTRKLLEE
TDLSDDQKQFVETSAVCERQMQKVMDDMDLESLEDG*YMELDTAEFILGTVI
DAVVSQGMIVLREKGLQLIREIPGEVKTMRLY**GDQVRLQQILADFLLNVLRF
TPSPEGWVAIKVFPTLKQLGGGLHVVHLEFRITHPGPGLPAELVQDLFDRS
QWATQEGVGLSMCRKLLKLMNGDVQYIRESGICYFLVNVEFPMA**QREDAA
SIK

FIGURE 119: Amino acid sequence of SEQ ID NO: 266. The conserved Cellular retinaldehyde-binding (CRAL)/Triple function domain (TRIO) is underlined.

MATVPQEAINELQALMDRVDEPLMRTFENIHQGYLKETLVRFLKAREGNVAK
AHKMLLDCLKWRVQNEIDIILSKPII<u>PDDLYRAVRDSQLIGLSGYSKEGLPVYA
IGVGLSTFDKASVHYYVQSHIQINEYRDRVILPSASKRYGRPITTCLKVLDMS
GLRLSALSQIKLLTIISTVDDLNYPEKTNTYYIVNAPYVFSACWKVVKPLLQER
TRKKVQVLPGCGRDDLLKIMDYSSLPHFCKGEGSGSGRHTSYGPENCYSL
DHPFHQQLYSYIKE</u>QSQRRQPIQPIKQGSFHVALPEAAAEGTEIAKTIESELQ
KFENGSGMPDSLDGLKINGE

FIGURE 120: Amino acid sequence of SEQ ID NO: 327. The conserved C-terminal of the cellular retinaldehyde-binding/triple function family domain is underlined.

```
MGHNTSEAIKQMTAFIDGVDEPLKKSFQTMHRGYAQQTLERFLKAREGNVQ
KANKMLLDCLSWRVQNHIDNILAKPIEPREVYNAVRESQLMGMTGYCKKGR
PVFAIGVGLSGYDKASADKYVQSHIQINEYRTKFSLPNASKKYGSYIGPCLKI
LDMTGLKLSALNRIKILTTIATVDDLNYPAEXRSTYYIVNAPYVFSACWKVVKP
LLQEGLDEKLQVLQGCGREELLKVMDYDVLPHFSRQEGSGSSKHHNGKTID
CFSPDHPFHVELYNYIKQQAAIIKPVAPEKMRSFHVDVPEQDDEGTIIVQTLRI
CIT
```

FIGURE 121: Amino acid sequence of SEQ ID NO: 257. The conserved C-terminal of the cellular retinaldehyde-binding/triple function family domain is underlined.

MADTATRAIPPRMEFSDEAAAGGAAAPAAAAAAAEEEEEEEEAPSPAAEISE
VEKSKIGIMRAVVERDDPSAKDVDDFMIRRFLRARDLDIEKASKLFLKYLSWR
RSFVPNGVISASEVPNNLAQRKLFMQGLDKKGRPIIVVYGGRHNPSKGSLEE
FKRMILLRMPGGQEKFMGIADLEGWGYKSSDIRGYLAALSILQDCYPERLGK
LFLIHVPYIFMTAWKMVYPFIDPKTKKKIVFVDNKKLRTTLLGDIDESQLPDVY
GGRLPLVAIQDS

FIGURE 122: Amino acid sequence of SEQ ID NO: 319. The conserved N- and C-termini of the cellular retinaldehyde-binding/triple function family domain are underlined.

MDRLISGQTTCNSV<u>EKQSNGDSNLDYSVSDAVRDKLRLMRDRIEKEDPASK
VTDDGTLLRFLYARESNVEKACEMFAKYRKWRQTYVPLGYIPETMVGNELK
HKFVYMQGYDKVGRPIMVLRLARHIASQSNMEDFKRFVVYAFDKMSASATK
GQTKFSIIADFADWAYKNVNLRGTIAAVQTLQDFYPERLGKVYLINRPYIFWA
AWKIVSPFIDKVTRQKIVFTDDKYVKETLLKDIDENQLPEIYGGKLPLVAIDDC
VVPNWPPITS</u>F

FIGURE 123: Amino acid sequence of SEQ ID NO: 329. The conserved C-terminus of the cellular retinaldehyde-binding/triple function family domain is underlined.

MDRLSNGQTTCNSVEKGNDGGLNFDNSISDAVRTKLRQMRDVIEKEDPSSK
VTDDDTLRRFLYARELNVEKASVMFSKYRKWRQTFVPLGYIPETMIRDELM<u>K</u>
<u>NSVHMQGFDKRGRPIAVIFLARHIPCRKTIENLKCHFVYIFDKMSASSRGQTK</u>
<u>FTIIADFDGWTYKNVDIRGAIAVLEILQDYYPERLGKVYLIHRPYIFWAAWKIVS</u>
<u>PFIDQVTREKIVFVEDKHLNETLLNDIDESQLPEIYGGKLPLVKIQDCVVPNWP</u>
<u>PITST</u>

FIGURE 124: Amino acid sequence of SEQ ID NO: 361. The conserved N- and C-termini of the cellular retinaldehyde-binding/triple function family domain are underlined.

MGSSSHRENGAVKAVSCSKEDKLEQSRVNLMRSIVEAKDSSAKATDDATLR
RFLRARDLNVGKASELFLKYLKWKRAFVPLGYIPESEVSNELRKNKIFIQGLD
KQRRPIGVILAARHNAFDRDLEEFKRLVVYGFDKICACMPRGQEKFVMLADL
EGWGYKNVDIRAYLMVLEIMQDCYPERLGKLFMIHVPYLFWAAWKTVYPFID
KVTKKKIVFVEDKHLKETLLNDIDESQLPEIFGGKLPLVPTQDCVIPN

FIGURE 125: Amino acid sequence of SEQ ID NO: 210. The conserved Ras GTPase superfamily domains are underlined.

MEDDERGEEYLFKIVLIGDSAVGKSNLLSRFALDEFDINTKATIGVEFQTQVV
EIDGKEVKAQIWDTAGQERFRAVTSAYYRGAVGALIVYDITRRTTFESVKRW
LDELDTHCDTAVARMLVGNKCDLNNIREVSTEEGKALAEAEGLFFMETSALD
STNVQISFEIVIREIYKNISRKVLNSDSYKAELSVNRVTLAKNGADSSGRSFYS
CCAR

FIGURE 126: Amino acid sequence of SEQ ID NO: 211. The conserved domain of the Ras GTPase superfamily is underlined and the GTP-binding nuclear protein Ran is in bold.

MSSSDEEGGEEYLF<u>KIVIIGDSAVGKSNLLSRYARNEFNPHSKATIGVEFQT</u>
<u>QSMDIDGKEVKAQIWDTAGQERFRAVTSAYYRGAVGALVVYDITRRSTFD</u>
<u>SVSRWLDELKTHSDTTVARMLVGNKCDLESIRDVTVEEGKSLAESEGLFF</u>
<u>METSALDATNVKTAFEIVIKEIY</u>NNVSRKVLNSDAYKAELSVNRVTLAGNGA
DGSKRSQSFSCCSR

FIGURE 127: Amino acid sequence of SEQ ID NO: 354. The conserved Ras GTPase superfamily domains are underlined.

MEDDPGEDYLF<u>KVVLIGDSAVGKSNLLSRYARNEFHMNSKATIGVEFQTQS
MEFDGKEIKAQIWDTAGQERFRAVTSAYYRGAVGALVVYDISRRHTFESVG
RWLDELKMHSDMNVVTMLVGNKCDLESLREVPVEESKALAEAEKLFFIETS
ALNATNVNDAFQIVIKEVYNNMSRKALNSGSYKSKLLSNGSTSVNLVQNGDA
ATKTGLKKYGCC</u>

FIGURE 128: Amino acid sequence of SEQ ID NO: 362. The conserved domain of the Ras GTPase superfamily is underlined.

MENVGGEEYLFKIVVIGDSAVGKSNLLSRYARNEFNANSKATIGVEFQTQVM
DIDGKEVKAQIWDTAGQERFRAVTSAYYRGAVGALIVYDISRRLTFDNVARW
LEELKMHADGNVVKMLVGNKSDLAHIREVPVEDGKKLAESEGLFFIETSALD
NTNVLPAFQIVVKEIYTNVSKKMLNSDSYKSQLSLNRVNITDAYGDGDGVDP
PKTKNSCC

FIGURE 129: Amino acid sequence of SEQ ID NO: 300. The conserved Ras GTPase superfamily domains are underlined.

MRVTEQPEDYLF<u>KIVLIGDSAVGKSNLLARYARNEFYPNSKSTIGVEFQTQT MEIDGKEIKAQIWDTAGQERFRAVTSAYYRGAVGALVVYDISRRQTFDNISR WLDELHTHSDMNVVTVIVGNKTDLMDAREVSTEEGAALAEAQNLYFVETSA LDSTNVQVAFQTVVKEIYNILSRKVLSCQEQKLESKLTNGKTVILHEAESEST TKQTGKFWCCSG</u>

FIGURE 130: Amino acid sequence of SEQ ID NO: 301. The conserved domain of the Ras GTPase superfamily is underlined and the GTP-binding nuclear protein Ran is in bold.

MMSYAGEEQPEDYLFKIVLIGDSAVGKSNLLARYARNEFYPNSKSTIGVEFQ
TQTMEIDGKEIKAQIWDTAGQERFRAVTSAYYRGAVGALVVYDISRRQTFDN
ISRWLDELHTHSDMNVVTVIVGNKTDLMDAREVSTEEGAALAEAQNLYFVET
SALDSTNVQVAFQTVVKEIYNILSRKVLSCQEQKLESKLTNGKTVILHEAESE
STTKQTGKFWCCSG

FIGURE 131: Amino acid sequence of SEQ ID NO: 233. The conserved Ras GTPase superfamily domains are underlined.

MGCSSSLPDRASGRLGGLNSENGAVNDAKNLRVKLVLLGDSGVGKSCIVLR
FVRGQFDPTSKVTIGASFLSQTIALQDSTTVKFEIWDTAGQERYAALAPLYYR
GAAVAVVVYDITSPESFQKAQYWVKELQKHGSPDMVMALVGNKADLQENR
EVTVQDGIDYAEKNGMFFIETSAKTADNINQLFEEIAKRLPRPTPS

FIGURE 132: Amino acid sequence of SEQ ID NO: 264. The conserved domain of the Ras GTPase superfamily is underlined and the GTP-binding nuclear protein Ran is in bold.

MAGGEAFSSNPPPPKPAILGNNSKTINA<u>KLVLLGDMGAGKSSLVLRFVKDQ</u>
<u>FFDFQESTIGAAFFSRTVGVNDASVKFEIWDTAGQERYHSLAPMYYRGAA</u>
<u>AAIVVYDITSTESFERAKKWVEELHKQGNPNLIITLAGNKTDMEDKRKVAAE</u>
<u>EACMYAEERRLVFIETSAKTATNVSKLFYEIAKRLPR</u>VQAMQNSAPAGMVL
ADTSSEETRSASCCS

FIGURE 133: Amino acid sequence of SEQ ID NO: 267. The conserved domain of the Ras GTPase superfamily is underlined and the GTP-binding nuclear protein Ran is in bold.

MARAGNKNIQA<u>KLVLLGDMGAGKTSLVLRFVKGQFHEYQESTIGAAFFTQV</u>
<u>LSLNEATVKFDIWDTAGQERYHSLAPMYYRGAAAAVVVYDLTSMDSFQRA</u>
<u>KKWVLELQRQGNPKLIMFLVANKADLEQKRQVLSEEGEQYAKENGLSFLE</u>
<u>TSAKTAQNVNELFYEIAKRIAK</u>ATPSRPTGMKLQRQESRRSLFCCSG

FIGURE 134: Amino acid sequence of SEQ ID NO: 298. The conserved domain of The Ras GTPase superfamily is underlined and the GTP-binding nuclear protein Ran is in bold.

MATTGTNNMQA<u>KLVLLGDMGTGKSSLVLRFVKGQFLDYQESTIGAAFFSQ</u>
<u>TLAVNEVTVKFEIWDTAGQERYHSLAPMYYRGAAAAIIVYDITNLDSFVRAK</u>
<u>NWVLELQKQGNPNLVMALAGNKADMAAKRKVEPEEAETYAKENGLFFME</u>
<u>TSAKTAQNVNELFYEIARRLPK</u>ARPVQQPAGMVLTDRPAESAKTYSCCS

FIGURE 135: Amino acid sequence of SEQ ID NO: 376. The conserved Ras GTPase superfamily domains are underlined.

MATVGNKNVQA<u>KLVLLGDMGAGKSSLVLRFVKGQFFAYQESTIGAAFFSQT
LAVNETSVKLEIWDTAGQERYHSLAPMYYRGAAAAIIVYDITNLDSFVRAKK
WVQELQRQGNPNMVIALAGNKSDMIENSKVSPEEAKVYAQENGLFFMETS
AKTAQNVNELFYEIARRLPKAEPVQHPAGMVLADRSAERARSNSCCS</u>

FIGURE 136: Amino acid sequence of SEQ ID NO: 205. The conserved domain of the Ras GTPase superfamily is underlined and the GTP-binding nuclear protein Ran is in bold.

MASRRRMLLKVIILGDSGVGKTSLMNQYVNRKFSNQYKATIGADFLTKEVQ
FEDRLFTLQIWDTAGQERFQSLGVAFYRGADCCVLVYDVNVMKSFDNLNN
WREEFLLQASPSDPENFPFVVLGNKIDVDGGNSRVVSEKKAKAWCASKG
NIPYFETSAKEGFNVEAAFECIAKNALKNEPEEEIYLPDTIDVTGGGRQQRS
TGCEC

FIGURE 137: Amino acid sequence of SEQ ID NO: 215. The conserved domain of the Ras GTPase superfamily is underlined and the GTP-binding nuclear protein Ran is in bold.

MASRRRMLL<u>KVIILGDSGVGKTSLMNQYVNRKFSNQYKATIGADFLTKEVQ FGDRLFTLQIWDTAGQERFQSLGVAFYRGADCCVLVYDVNVMKSFDNLNH WREEFLIQASPSDPENFPFVVLGNKIDIDGGNSRVVSEKKAKAWCASKGNI SYFETSAKEGFNVEAAFQCIAKNALK</u>NEPEEELYLPDTIDVAGGQQQRSSG CEC

FIGURE 138: Amino acid sequence of SEQ ID NO: 241. The conserved domain of the Ras GTPase superfamily is underlined and the GTP-binding nuclear protein Ran is in bold.

MASRRRMLLKVII<u>LGDSGVGKTSLMNQYVNRKFSNQYKATIGADFLTKEVQ</u>
<u>FEDRLFTLQIWDTAGQERFQSLGVAFYRGADCCVLVYDVNVMKSFDNLNN</u>
<u>WREEFLIQAGPSDPENFPFVVLGNKVDVDNGNSRVVSEKKARAWCASKG</u>
<u>NIPYFETSAKEGFNVEAAFECIAKNAL</u>KNEPEEEIYLPDTIDVAGGARQQRS
TGCEC

FIGURE 139: Amino acid sequence of SEQ ID NO: 285. The conserved Ras GTPase superfamily domains are underlined.

MPSRRRTLL<u>KVIILGDSGVGKTSLMNQYVNKKFSNQYKATIGADFLTKEVQL DDRLFTLQIWDTAGQERFQSLGVAFYRGADCCVLVYDVNVMKSFDNLNNW REEFLIQASPSDPENFPFVVIGNKIDVDGGNSRVVSEKKARAWCASKGNIPY FETSAKEGVNVEEAFQCIAKNALKSGEEEEIYLPDTIDVANSSQPRPSGCEC</u>

FIGURE 140: Amino acid sequence of SEQ ID NO: 291. The conserved Ras GTPase superfamily domains are underlined.

MSARRRTLL<u>KVIILGDSGVGKTSLMNQYVNKKFSNQYKATIGADFLTKEVQF
EDRLFTLQERFQSLGVAFYRGADCCVLVYDVNVLKSFDNLNNWRDEFLIQA
SPSDPENFPFVVLGNKIDVDGGNSRVVSEKKARAWCASKGNIPYFETSAKE
GFNVEAAFQCIAKNALKNEPEEEIYLPDTIDVNAGRPQRTSGCDC</u>

FIGURE 141: Amino acid sequence of SEQ ID NO: 292. The conserved Ras GTPase superfamily domains are underlined.

MSARRRTLL<u>KVIILGDSGVGKTSLMNQYVNKKFSNQYKATIGADFLTKEVQF</u>
<u>EDRLFTLQIWDTAGQERFQSLGVAFYRGADCCVLVYDVNVLKSFDNLNNW</u>
<u>RDEFLIQASPSDPENFPFVVLGNKIDVDGGNSRVVSEKKARAWCASKGNIPY</u>
<u>FETSAKEGFNVEAAFQCIAKNALKNEPEEEIYLPDTIDVNAGRPQRTSGCDC</u>

FIGURE 142: Amino acid sequence of SEQ ID NO: 302. The conserved Ras GTPase superfamily domains are underlined.

MATRKRTLL<u>KVIILGDSGVGKTSLMNQYVNKKFSNQYKATIGADFLTKEVQV EDRLVTMQIWDTAGQERFQSLGVAFYRGADCCVLVYDVNVIKSFDNLDNW HQEFLIQANPNDPDNFPFVVLGNKTDVDGGHSRVVSEKKAKMWCAAKGNIP YFETSAKEDMNVEEAFQCIAKNALKNEPDEEIYLPETIDVGHIGVQRPSACQ C</u>

FIGURE 143: Amino acid sequence of SEQ ID NO: 303. The conserved Ras GTPase superfamily domains are underlined.

MATRKRTLL<u>KVIILGDSGVGKTSLMNQYVNKKFSNQYKATIGADFLTKEVQV
EDRLVTMQIWDTAGQERFQSLGVAFYRGADCCVLVYDVNVIKSFDNLDNW
RQEFLIQANPNDPDNFPFVVLGNKTDVDGGHSRVVSEKKAKMWCAAKGNIP
YFETSAKEDMNVEEAFQCIAKNALKNEPDEEIYLPETIDVGHIGVQRPSACQ
C</u>

FIGURE 144: Amino acid sequence of SEQ ID NO: 304. The conserved Ras GTPase superfamily domains are underlined.

MVLRISELTIGYVYTGLKLKEAWIMATRKRTLL<u>KVIILGDSGVGKTSLMNQYV
NKKFSNQYKATIGADFLTKEVQVEDRLVTMQIWDTAGQERFQSLGVAFYRG
ADCCVLVYDVNVIKSFDNLDNWRQEFLIQANPNDPDNFPFVVLGNKTDVDG
GHSRVVSEKKAKMWCAAKGNIPYFETSAKEDMNVEEAFQCIAKNALKNEPD
EEIYLPETIDVGHIGVQRPSACQC</u>

FIGURE 145: Amino acid sequence of SEQ ID NO: 350. The conserved Ras GTPase superfamily domains are underlined.

MSFRKRAL<u>FKVIVLGDSGVGKTSLVTQYVHKRFSSQYKATIGADFMSKELQV</u>
<u>DDRLVTLQIWDTAGQERFQSLGVAFYRGADCCVLVYDVNVLKSFDNLENW</u>
<u>HKEFLNQASPTEPDTFPFMLLGNKIDVDGGNSRVVSELKAMTWCKSKGIPY</u>
<u>FETSAKDDYRIDAAFLSIARSALKNQPEQEIYFLGLPEALPESEPPSRSFCGC</u>

FIGURE 146: Amino acid sequence of SEQ ID NO: 245. The conserved leucine-rich repeat, ribonuclease inhibitor subtype domain is underlined.

MDSTTHSFQRRPLSIKLWPPSQSTRIMLVERMTKNLIAPSVLSRKYGLLSKE
EAEEDAKRIEESAFAIANQHMEKEPDGDGSSAVQVYATQSSKLMLEVIKRGP
RMKVDGEAILPAKAIAASETVFDISGGRRAFIDAEEAEELLKPLKAPGNFYKKI
CFSNRSFGLDAARVAEPFLVSVKDKLTDVDLSDFVAGRPEAEALEVMNIFSS
ALE<u>GCNLRSLDLSNNALGEKGVRAFGALLKS</u>QNNLEELYLMNDGISEEAALA
VCELLPSTEKLRILHFHNNMTGDEGALAISEIVKHSPVLEDFRCSSTRVGSDG
GVSLCDALSACSRIKKLDLRDNMFGVESGVALSKAIPSFADLTEVYFSYLNLE
DEGTEALAIALKESAPSLEVLEMAGNDITAKAGAVLAACIAAKQFLTKLNLSE
NELKDEGAILIGKALEEGHGQLVEVDLSTNSIRRVGARVLAQAVVQKPGFKM
LNINANFISEEGLDEVKDIFKTSPNMLGPLDENDPEGEDFDEEADEEGAGHE
DELEAKLKDLEIKHEE

FIGURE 147: Amino acid sequence of SEQ ID NO: 260.

MDAAPLTSQRRPFSVKLWPPSKNTRETLVERMTRNLTSESIFTRKYGSLSPE
EAEENAKRIEDEAFTTANQHYEKEPDGDGGSAVQLYAKECSKLILEVLKKGP
KGKDEKPPTSDSAKAPRETFFDISKGQRAFIEAEEAEELLRPLKEPENSFTKI
CFSNRSFGLGAAHVAEPILISLKQQLKEVDLSDFIAGRPETEALEVMSIFSAAL
EGSVLNSLNLSNNALGEKGVRAFSALLKSQSQLEELYLMNDGISEEAARAVC
ELIPSTEKLRVLHFHNNMTGDEGAIAIAEVVKCSSLMEDFRCSSTRIGSDGGV
ALSEALENCIHLKKLDLRDNMFGVDAGVALSKALSKHTNLTEVYLSYLNLED
EGAIAIANVLKETASSLTVLDMAGNDITAEAAPTLSACIAAKNLLTKLNLAENE
LKDEGAIQIGKALQEGHEQLTEVDLNTNSIRRAGARFLAQVVVQKPGFKLLNI
DGNFISEDGIDEVKSIFKKSPEMLASLDENDPEGGDEDEEDEEGEAEGEADE
GELESKLKNLEVGEE

FIGURE 148: Amino acid sequence of SEQ ID NO: 381.

MGSTNNQSERAFSIKLWPPSESTRLMLVERMTDNLSSVSFFSRKYGLLSKE
EAAENAKRIEETAFLAANDHEAKETNSDDSSVVQFYAREASRLMLEALKRG
PTSQKQESEKELTAETVEVKETIFDISRGDRGFVDGTLAEELLRPLTEEGNSY
TKICFSNRSFGLDAARVAERALMEVQRNLTDVDLSDFIAGRPEVEALEVMTIF
ASVLQGCELRSLNLSDNALGEKGVRAFGPLLKSQKTLEELYFMNNGISVEAA
RAICELLPSVERLRVLHFHNNMTGDDGAEPLSELVRNCTALEDFRCSSTRV
GAVGGIALVGALGAGNRLKKLDLRDNMFGKKCGVALSRALSPHLGLTEAYL
SYLGFQDKGTIALANSLKEGAPSLKVLELAGNEITVKAATALAECLGLKRMLT
KLVLSENELKDEGSVLICRALEEGHEHLKELDLSSNSISGVGAKVAAELVVNK
PDFDLLNIDGNCISEEGIDAVKDVLRRGDKGVTVLGSLEDNDAEGEGNDYED
GDEDDDENESSDSDGDLVAKVEDLKMQ

FIGURE 149: Amino acid sequence of SEQ ID NO: 216. The conserved domain of the Ras GTPase superfamily is underlined and the GTP-binding nuclear protein Ran is in bold.

MAGGYRADDDYDYLF<u>KVVLIGDSGVGKSNLLSRFTRNEFSLESKSTIGVEF</u>
<u>ATRSIRVDDKVVKAQIWDTAGQERYRAITSAYYRGAVGALLVYDVTRHVTF</u>
<u>ENVERWLKELRDHTDSNIVIMLVGNKADLRHLRAVSTEDAKAFAERENTYF</u>
<u>METSALESMNVENSFTEVLTQIYHVVSRKAL</u>DVGEDPAAPPKGQTISVGSK
DDVSAVKKVGCCSA

FIGURE 150: Amino acid sequence of SEQ ID NO: 217. The conserved domain of the Ras GTPase superfamily is underlined and the GTP-binding nuclear protein Ran is in bold.

MVDSFDEECDYLF<u>KAVL</u>**TGDSAVGKSNLLSRFARKEFQLDSKPTIGVEFAY
RNVKVADKLIKAQIWDTAGQERFRAITSSYYRGALGALLVYDITRRVTFENV
KKWLRELRDFGNPDMVVVLVGNKSDLGSSREVDLEEGKDFAEAENLCFM
ETSALENLNVEEAFLEMITRIHE**<u>ITSQKSLEAKNNEITSSLHGPKQVIQIDEVT
ATKKPYCCSS</u>

FIGURE 151: Amino acid sequence of SEQ ID NO: 218. The conserved domain of the Ras GTPase superfamily is underlined and the GTP-binding nuclear protein Ran is in bold.

MAGYKADEEYDYLFKLVLIGDSGVGKSNLLSRFTRNEFNLESKSTIGVEFAT
KSLSIDGKVVKAQIWDTAGQERYRAITSAYYRGAVGALLVYDVTRRATFENV
ARWLRELRDHTDPNIVVMLIGNKSDLRHLVAVPLEDGKSFAEMSHYYFMQT
SALDATNVEAAFAEVLSQIYRIVSKRAVEAGDNPSVSCVPGQGQTINVKEEG
SVFKRIGCCSS

FIGURE 152: Amino acid sequence of SEQ ID NO: 219. The conserved domain of the Ras GTPase superfamily is underlined and the GTP-binding nuclear protein Ran is in bold.

MASGGGYGDGNQKIDYVF<u>KVVLIGDSAVGKSQILSRFARNEFSLDSKATIG</u>
<u>VEFQTRTLVIQHKSVKAQIWDTAGQERYRAVTSAYYRGAVGAMLVYDITRR</u>
<u>QSFDHIPRWLEELRSHADKNIVIILVGNKTDLENQRAVPTEDAKEFAQKEGL</u>
<u>FFLETSALDSTNVESAFLTVLTEIFN</u>IVNKKSLVAGESQTNGNPASLAGKKII
PGPAQEIPAKNKMCCGT

FIGURE 153: Amino acid sequence of SEQ ID NO: 226. The conserved domain of the Ras GTPase superfamily is underlined and the GTP-binding nuclear protein Ran is in bold.

MAGYRAEDDYDYLF<u>KIVLIGDSGVGKSNLLSRFTRNEFSLESKSTIGVEFAT RSLNVDGKVIKAQIWDTAGQERYRAITSAYYRGAVGALLVYDVTRHSTFEN VERWLRELRDHTDPNIVVMLVGNKSDLRHLLAVSTEDGKSFAEREALVFM ETSALEATNVENAFAEVLTQIYNI</u>VSKKALETSEQANGSAVPSQGEKIDVGK DVSAVKRGGCCSS

FIGURE 154: Amino acid sequence of SEQ ID NO: 229. The conserved Ras GTPase superfamily domains are underlined.

MANRVDHEYDYLF<u>KIVLIGDSGVGKSNILSRFTRNEFCLESKSTIGVEFATRT
LQVEGKTVKAQIWDTAGQERYRAITSAYYRGAVGALLVYDITKRQTFDNVQR
WLRELRDHADSNIVIMMAGNKSDLNHLRAVPGDDGQALAEKEGLSFLETSA
LDATNIEKAFQTILTEIYHIISKKALAAQEAAATTLPGQGTTINVADATGNANKR
GCCST</u>

FIGURE 155: Amino acid sequence of SEQ ID NO: 239. The conserved domain of the Ras GTPase superfamily is underlined and the GTP-binding nuclear protein Ran is in bold.

MARRAEEEYDYLF<u>KVVLIGDSGVGKSNLLSRFTRNEFCLESKSTIGVEFATR</u>
<u>TLQVEGRTVKAQIWDTAGQERYRAITSAYYRGALGALLVYDVTKPTTFDNV</u>
<u>SRWLKELRDHADSNIVIMLIGNKTDLKHLRAVATEDAQSYAEKEGLSFIETS</u>
<u>ALEATNVEKAFQTILSEIYRI</u>ISKKPLSSEDAAPANIKEGKTIVVGESEANTKK
ACCSSS

FIGURE 156: Amino acid sequence of SEQ ID NO: 255. The conserved Ras GTPase superfamily domain is underlined MAGGYRADDDYDYLF<u>KVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSNIVIMLVGNKADLRHLRAVSTEDATAFAEKENTFFMETSALESMNVENAFTEVLTQIHR</u>VVSRKALEAGNDPGALPKGQTINVGSKDDVSEVKKVGCCSS FIGURE 157: Amino acid sequence of SEQ ID NO: 275. The conserved Ras GTPase superfamily domain is underlined.

MAGYRAEDDYDYLY<u>KVVLIGDSGVGKSNLLSRFTKNEFNLESKSTIGVEFAT</u>
<u>RTLTVDGKVVKAQIWDTAGQERYRAITSAYYRGAVGALLVYDVTRHATFEN</u>
<u>VDRWLKELRNHTDPSIVVMLVANKSDLRHLIAVSTEDGKSYAERESLYFMET</u>
<u>SALEATNVENAFAEVLTQIYR</u>TTSKKTVEGDDGSAAAFPSQGEKINIKDDVSA
LKKVGCCST

FIGURE 158: Amino acid sequence of SEQ ID NO: 306. The conserved Ras GTPase superfamily domains are underlined.

MAYKVDDDYDYLF<u>KVVLIGDSGVGKSNLLSRFTRNEFSLESKSTIGVEFATR SINVDGKMIKAQIWDTAGQERYRAITSAYYRGAVGALLVYDITRHVTFENVER WLKELRDHTEHNIVVMLVGNKSDLRHLRAVSTEDAQTFAEREGLYFIETSAL ESTNVENAFKQVLTQIYRIVSKKALDVSEDNAAAPAQGQTINVKDDVTATKK VGCCSTS</u>

FIGURE 159: Amino acid sequence of SEQ ID NO: 318. The conserved domain of The Ras GTPase superfamily is underlined and the GTP-binding nuclear protein Ran is in bold.

MASPYGDYDQRIDYMF<u>KVVVIGDSAVGKSQILSRFAKNEFSLDSKSTIGVEF</u>
<u>QTRTVAIDNKTIKTQIWDTAGQERYRAVTSAYYRGALGAMLVYDITKRQSF</u>
<u>DHVARWLEELRGHADNNIVIMLIGNKCDLRDMRAVPEEDAKEFAQREGLY</u>
<u>FFETSALEAINVEMAFITALTEIYRIVSRKALTANEDERNGNAAALTGTKISL</u>
SSPEQSVMAVKKKSCC

FIGURE 160: Amino acid sequence of SEQ ID NO: 322. The conserved Ras GTPase superfamily domains are underlined.

MARRTDDEYDYLF<u>KVVLIGDSGVGKSNLLSRFTRNEFCLESKSTIGVEFATR
TVQVEGKTIKAQIWDTAGQERYRAITSAYYRGAVGALLVYDITKPTTFENVG
RWLKELRDHADSNIVIMLVGNKSDLKHLRGVSTEDAQSFAEKEGLSFLETSA
LEATNVERAFQTILAEIHRIISKKALASEEAAGAGIREGKTILVSEPDSNTKKAC
CS</u>

FIGURE 161: Amino acid sequence of SEQ ID NO: 335. The conserved Ras GTPase superfamily domains are underlined.

MAYRADDDYDYLF<u>KVVLIGDSGVGKSNLLSRFTRNEFSLESKSTIGVEFATR
SITVDDKVIKAQIWDTAGQERYRAITSAYYRGAVGALLVYDVTRHVTFENVE
RWLKELRDHTDANIVIMLVGNKADLRHLRAVSIEDGKAFAERENTYFMETSA
LESTNVENAFTEVLSQIYRIVSKKALDVGEDPAAVPSKGQTIHVGNKDDVTA
MKKVGCCSL</u>

FIGURE 162: Amino acid sequence of SEQ ID NO: 348. The conserved Ras GTPase superfamily domains are underlined.

MAYKADDDYDYLFKVVLIGDSGVGKSNLLSRFTRNEFSLESKSTIGVEFATR
SIIVDGKTIKAQIWDTAGQERYRAITSAYYRGAVGALLVYDITRHTTFESVER
WLKELQDHTDNNIVVMLVGNKADLRHLRAVSTEDSQALAERESLYFMETSA
LESTNVENAFTQVLTQIYRIVVKKALDVSEEPSALPPQGQAINIKDDVTATKK
PMCCNF

FIGURE 163: Amino acid sequence of SEQ ID NO: 383. The conserved Ras GTPase superfamily domains are underlined.

MARKVDDEYDFLF<u>KVVLIGDSGVGKSNLLSRFTRNEFCLESKSTIGVEFATR
TIQVDGKTIKAQIWDTAGQERYRAITSAYYRGAVGALLVYDITKNATFDNVKR
WLRELRDHADSNIVIMLVGNKCDLNHLRAVPIDEAQDFAEKEGLSFMETSAL
ESTNVEKAFQSILAEIYQIVKRKSLAAEEAASSGPSQGTPINVTDAEAVAKKR
SCCL</u>

FIGURE 164: Amino acid sequence of SEQ ID NO: 387. The conserved Ras GTPase superfamily domains are underlined.

MAYKTEEDYDYLF<u>KVVLIGDSGVGKSNLLSRFTRNEFSLESKSTIGVEFAAR SVNVDGKSIKAQIWDTAGQERYRAITSAYYRGAVGALLVYDITRHVTFENVE RWYKELKDHTDVNIVVMLVGNKSDLLHLRAVSVEEGKSFAERESLYFMETS ALDSTNVENSFTQVLTQIYRIVSKRSLDTAEEALSTLPGKGQSISVNGKDEFT TKKAGCC</u>

FIGURE 165: Amino acid sequence of SEQ ID NO: 393. The conserved Ras GTPase superfamily domains are underlined.

MTEGSNYDFLF<u>KVVLIGDSGVGKSNLLSRFTRNEFNLDSKSTIGVEFATRSV QVDSKTVKAQIWDTAGQERYRAITSAYYRGAVGALLVYDIAKHPTYQNVHR WLKELRDHADSNIVIMLVGNKSDLKHLRAVPTDEAKAFATENNLSFIETSALD ASNVEAAFQNILSDIYHIVAKKNLENSSDVIQPLEGRGIDIAKSEDDGGAKQG GKCC</u>

FIGURE 166: Amino acid sequence of SEQ ID NO: 225. The conserved protein kinase family domain is underlined and the protein kinases ATP-binding region and serine/threonine protein kinases active-site signatures are in bold. The Ubiquitin-associated family domain is in bold/italics.

MGESRRGEMDGTTRGGSNADMYLPN<u>YKLGKTLGIGSFGKVKIAEHVLTGH</u>
<u>KVAIKILNRRKIKNMEMEEKVRREIKILRLFMHPHIIRLYEVIETPTDIYVVMEY</u>
<u>VKSGELFDYIVEKGRLQENEARNFFQQIISGVEYCHRNMVVHRDLKPENLLL</u>
<u>DSKWNVKIADFGLSNIMRDGHFLKTSCGSPNYAAPEVISGKLYAGPEVDVW</u>
<u>SCGVILYALLCGTLPFDDENIPNLFKKIKGGMYTLPSHLSAGSKDLIPRMLIVN</u>
<u>PMKRITIPEIRQHPWF</u>QAHLPRYLAVPPPDTMQQAKK*IDEEILQEVVNMGFE*
*RNQLVESLRNRIQNEATVAYYLLLD*NRFRPSNGYLGDEFQETMECTFNRG
NPGELTIPTVGPRYPLPGYMDYQGVNSKPGYYGAEKKWALGLQSRAHPREI
MTEVLKALRELNVCWKKIGHYNMKCMWNPCVPSHESMVSNPVQSNYFGD
ESTIIENDGATKSRNVVKFEVQLYKTTEEKYLLDLQRVQGPQFLFLDLCAAFL
AQLRVL

FIGURE 167: Amino acid sequence of SEQ ID NO: 310. The conserved protein kinase family domain is underlined. The protein kinases ATP-binding region is in bold and the serine/threonine protein kinases active-site signature is in bold/italics. The C-terminus of the kinase associated domain is in italics/underline.

MDGMSTRGGSNFDMYLPNYK<u>LGKTLGIGSFGKVKIAEHALTGHKVAIKILN
RRKIRNMDMEEKVRREIKILRLFMHPHIIRLYEVIETPSDIYVVMEYVKSGDLF
DYIVEKGRLQEDEARCFFQQIISGVEYCHRNM*IVHRDLKPENLLL*DSKCNVKI
ADFGLSNVMRDGHFLKTSCGSPNYAAPEVISGKLYAGPEVDVWSCGVILYA
LLCGSLPFDDENIPNLFKKIKGGIYTLPSHLSSGARDLIPRMLVVDPMKRMTIP
EIRQHPWFLEKLPRYLAVPPPDTIQQAKKIDEEILQEVIKRNFDRNQLVESLR
SRIQNEATVAYYLMLDNRSRISNGYLGSEFQEAKDCIHHFVPTDRATPTGDH
RLTGFINQGNASRSQFPIERKWALGLQSQAHPREIMSEVLKALQELDVAWK
KIGHYNMKCRWFPAVLRKVDSSMNKSLHGNHIIQDDSTAGIN*CRSPPNVVK
FEVQLYKAREEKYLLDLQRVQGPHFLFLDLCADFLAQLRVL*</u>

FIGURE 168: Amino acid sequence of SEQ ID NO: 242. The conserved C-terminal 3-oxo-5-alpha-steroid 4-dehydrogenase family domain is underlined.

MLTISDEKLFHNCLLALYLIGPPTFISLRYIQAPYGKHHRSGWGPTISPALAWF
LMESPTLWLTLLIFPFGKNSSNARSLILISPFLFHYFHRTIIYPLRIRSSGGQRS
TQPNAA<u>NRFPVTVAFMAFGFNLLNAYVQARWVSNYESDGAAGGWWFWGR
FLVGLVIFVSGMYMNMSSDMVLVGLKREGKGYRVPRGGLFEFVSCPNYFG
EIVEWLGWAVMTWSWAGFGFFLYTCANLVPRARANHRWYLDKFGEEYPKS
RKAVIPFLY</u>

FIGURE 169: Amino acid sequence of SEQ ID NO: 243. The conserved ERG4/ERG24 ergosterol biosynthesis protein family domain is underlined MAEA<u>KTVHSPLVTYFSMLSLLTLCPPFVILLWYTMVHADGSIVQTFDYLRQH
GLQGFLDIWPRPTAVAWKIIAVYAAFEAALQLLLPGKTVKGPISPAGNQPVYK
ANGMAAYFVTLITYLGLWWFGIFNPTVVYDHLGEIYSALIVGSFIFCIFLYIKGH
VAPSSTDSGSSGNIIIDFYWGMELYPRIGKDFDIKVFTNCRFGMMSWAVLAL
TYCIKQYEQNGKVADSMLVNTILMLVYVTKFFWWEAGYWNTMDIAHDRAGF
YICWGCLVWVPSIYTSPGMYLVNHPVNLGTQLALYILVAGILCIYINYDCDRQ
RQEFRRTNGKCSVWGKAPSKISASYTTTSGENKTSLLLTSGWWGLSRHFH
YVPEILGAFFWTVPALFNHFLPYFYVIFLTILLFDRAKRDDDRCRSKYGKYWK
LYCEKVRYRIIPGIY</u>

FIGURE 170: Amino acid sequence of SEQ ID NO: 281. The conserved sterol desaturase family domain is underlined MDAGYLFKEETSLYNRIVLGSLLPASAWEPMPRLLQTWLRNYIGGTLIYFLS
GFLWCFYIYYLKRNVYVPKDEIPTRKAMLLQIYVAMKAMPWYCALPTLSEYM
VENGWTKCFSRISDVGWLAYLVYLSIYLVMAEFGIYWMHRELHDIKPLYKHL
HATHHIYNKQNTLSPFAGLAFHPLDGILQAVPHVMALFLVPTHFTTHIALLFLE
AIWTANIHDCIHGKLWPVMGAGYHTIHHTTYRHNYGHYTIWMDWMFGTLRD
PIDDGSKKEM FIGURE 171: Amino acid sequence of SEQ ID NO: 287. The conserved cytochrome P450 family domain is underlined.

MGAWLGCILGLIPLLGCCLWWWNEIRYVWPVKRRCSGTNAKL<u>PPGHMGFP</u>
<u>FFGELFTFLWYYKILRRPDEFINSKRKKYGDGVGMYRTHLFGSPSIIACVPSV</u>
<u>NKFVFRAEDTFIAQWPNVDIMGTNSLGAVHGKAHDRLRSFVLNAVNRPDAL</u>
<u>RRIAALVQPRLVSALELWAQKGRIVAFHETKKVTFENIGKLFVSFEPGPQLEK</u>
<u>IDGLFHDMLKGMRAQRLNFPGTAYRCALQARKKVEAIFRVELEERKSRSEET</u>
<u>VTDLMDELRQIKDEEGRKLSDQEVLDNIVSFVFAGYESTSLASMWAIYYLAK</u>
<u>SPNVLKKLREENTSVSQNKKGEFITSEDISNMKYTKKVVEETLRMANISHFLF</u>
<u>RLVTKDIEYKGYRIPKGWKVILWLRYLHTNPENFDDPMCFNPERWNDSVKP</u>
<u>EAYQVFGGGSRICPGNMLARIQLAILLHHLSVEYKWELINSDAGFVYLPHPA</u>
<u>PVDEVEVSFSKL</u>

FIGURE 172: Amino acid sequence of SEQ ID NO: 289. The conserved cytochrome P450 family domain is underlined.

MAVYIFLALGVVLVLCVCTALLRWNEVRYMKKGL<u>PPGTMGWPVFGETTEFL</u>
<u>KQGPNFMKNQSARYGSFFKSHILGCPTIVSMDPEVNRYILMNEAKGLVPGY</u>
<u>PQSMLDILGKRNIAAVHGASHKHMRGALLSLVSPTMIRDQLLPKIDRFMRSH</u>
<u>LARWDDGSIIDLQDKTKQMALLSSLMQIGIDSSSISQEFIPEFFKLVLGTLSLPI</u>
<u>DLPGTNYRRGFQARKNILGMLRKLIEERRASQEAHNDMLGCLMRSDDNKYK</u>
<u>LNDEEIIDQIITIMYSGYETVSTTSMMAVKYLHDNPSVLHELRKEHLGIRAKKR</u>
<u>PEDPIEWDDLKAMRFTRAVIFETSRLATVVNGVLRKTTKDMELNGFLIPKGW</u>
<u>RIYVYTREINYNLRLYPDPLAFNPWRWLDKSVECQNYNLIFGGGTRQCPGK</u>
<u>ELGIAEISTFLHYFVTRYRWEEIGGDKLMKFPRVEAPNGLHIRV</u>SPQC

FIGURE 173: Amino acid sequence of SEQ ID NO: 328. The conserved cytochrome P450 family domain is underlined.

MAETVTYSWPVGFVCFVLTMLLLQLYRIVWREDSRGYNLPPGSSGWPLIGE
TLSFMRGINSISKPRQFIQDREQRYGKIFRTNLFGRSRMIVSVDPEFNKYILQ
HEGRLVQSSYLRPFRKLIGKYGLLSVYGDLQKKLHGTAVNFLRFERLSVHFM
EDIQNLMHTTFAQWQAKGHIHLYHECHQFVLNLMAKQLLDLSPSKETEEIGK
AFGDFSKSFVVLPIRIPGTAYWKGLKARDFLMKKIYASIKYRREHPEVVHNDF
LGELLKEDLHSEEIIADFVLFLLFAGHETSASTMAFAIKFLTDCPQALRELKAE
HNALLKRKGSPRNQNLTWDDYQSLKFTQCVINETHRLANVAPAVFREAIADI
KIKGFVIPKGWSVLVLMNGIHLDDKYHSSPLKFDPWRWQQILENNELYKNPS
FMPFGGGLRLCPGMHLAKLELGLFLHHFITKFRWEPLDDDKISYFPVSHLTK
GFPIRLHPQEQMDD

FIGURE 174: Amino acid sequence of SEQ ID NO: 332. The conserved cytochrome P450 family domain is underlined.

MGSGIMTETLTDSWLVGLLCLVLGFLLLQLYKLVWGASSRAYKL<u>PPGSTGW
PLIGETIGFFRGINSTAQPRQFIQERERRYGEIFRSNLFGRSRIVVSVDPEFNK
HVLQHEGRQFQANYPKPLRNLIGKYGLLSVHGDLQRKLHGAAVNLLRFERL
SVDFMEDIQNLLHITLAKWEAKRDIHLQEECHQLVLNLMAKQLLDLSPSKDTE
EICEAFGHFSEALLAVPIKIPGTKYARGFKAREFLIKKIYESIEDRRQHPEAVH
NDLLTKLLKEDTFSEEIIADFILFLLFAGHETSSRSMSFAIKFLTDCPRALEELK
AEHDALLMRKGNLKNQKLNWDDYQSLKFTQCVIHETLRVGNFGPGVFRETK
EDIKTKGGFVIPRGWTVYVFLTGTHLDEKYHSSALKFDPWRWQPHLQDQEL
LKNPSFMPFGGGARLCPGMHLAKMELALFLHNFVTKFRWEALQDDKISYFP
FPRLIKGLPIRL</u>RLRE

FIGURE 175: Amino acid sequence of SEQ ID NO: 333. The conserved cytochrome P450 family domain is underlined.

MAIMGETLHSLLVGLVCFALGMLLLELYKLVWRVDSRSYKLPPGSTGLPLIG
ETISFFRGINSTDQPRRYIQEREKRYGEIFRSNLFGRSRIVVSVNPEFNKHVL
QHEGRQFQANYPKPLRNLIGKFGLLAVHGDLQKKLHGTAVNLLRFERLSVD
FMTDIQNLLHTTLPKWQAKRDIHLQEECHQLVLNLMAKQLMDLSPSKETEEI
CEAFGHFSEALLAIPLRIPGTAYARGFKAREFLIKRIYEGIEDRRKHPQVVRND
LLTKLLKEDSFSEELIADFILFLLFAGHETSSRSMSFAIKFLTDCPKAYQELKA
EHDALLQRKGNRRNGNLTWDDYQSMKFTQCIINETLRLGNFAPGAFREAKE
DVKTKGGFVIPKGWTVYVFLTGTHLDEKYHSSALTFNPWRWQQLLQDQELS
KNPSFMPFGGGARLCPGMHLAKLELALFLHNFVTKFRWEALQDEKISYFPF
PRLIKGLPIRLHPQERLGD

FIGURE 176: Amino acid sequence of SEQ ID NO: 345. The conserved ERG4/ERG24 ergosterol biosynthesis protein family domain is underlined.

MAKKQAGKSNDSTVNDSGSENETKKPAGSKEDGSIHSPLVAYASILSLLSCT
PPFVIFLWYTMVHLDGSASQFWDLCKEQGLQGFLRIWPKPTLIAWKLIASFA
AFEAALQLLLPGERVTGPVSPAGNIPVYKANGVLAYFVTLTTYIAIWWFGLFN
PAIVYDHLGEIFSALIIGSFIFCIFLYIKGHVAPSSTDSGSSGNVVIDFYWGMEL
YPRIGKNFDIKVFTNCRFGMMSWAVLAVTYSIKQYEEYGRVADSMLVSSILM
VVYVTKFFLWESGYWNTMDIAHDRAGFYICWGCLVWVPSVYTSPAMYLVR
HPISLGLKLSLGILIAGIACIFINYDCDRQRQLFRKTNGNCLIWGRPPSKIEAW
YETMSGEKKSSLLLTSGWWSVSRHFHYVPEILAAFFWTLPGLFNHFLPYFYV
IFLTILLFDRAQRDDQRCRAKYGKYWDIYCKQVKYNIIPGIY

FIGURE 177: Amino acid sequence of SEQ ID NO: 378. The conserved cytochrome P450 family domain is underlined.

MDNGMMVWIVLAGVVAMAVWYLLVQHQQPKQSHNVPWETL<u>PPGAVGWP
FLGEIISFYFRTPDFVKQRRGRYGNLFRTFLIGYPMVISTDPEVNKFILNNDGR
LFVPAYPSHWSQIIGECNIFAARGDFHKRMRGAFLHFISISVVKNRLLSEIQNII
TFSLAGWEGRNVNVLHEAEEMIFSVMANHMLSLSAGTALESMKRDFLVMM
KGLRSLPLRVPGTTFYKSLQKKQVLFNQIKSIIEERKLNMSAYDSYDDLLSSIL
RSASEKEFTTTQIVDLIVQSVIGSLETTPKIMASVVRHLSENPHIIIYLKEEHETII
QAKENNQSLSWDDYKSMVFTKSVIKETLRFGMQPLNNIMFKKTLQDVKIEGY
TIPKGWTCIIYDLVSDMDTKYCKDPLSFNPQRWQSKEMNEVPFLAFGGGPR
LCPGYELAMLTMSFFLHHLVTKFRWEYLPSKSELRWFDSPLNSVFDCRIHVE
NR</u>

FIGURE 178: Amino acid sequence of SEQ ID NO: 384. The conserved ERG4/ERG24 ergosterol biosynthesis protein family domain is underlined.

MNAG<u>PLIAALRDCPLLAFPSWTAAGIILAYFCYMALAQFILPGKQIPGVVLADK
TRIYYRCNGFITLFLLVTLLGISMAAGILSLAVVADKGGELLSTTLILSALISLFL
YVAGHLSQSKMTSLKPHITGNFIHDVVWFGIQLNPQFLGIDLKFLLIRSGMIGW
AVINLSVAAKAFQLKDSLNLSMILYQIFCLLYVMDYFWYEEYMTSTWDIIAENL
GFMLVFGDLVWIPFTFSIQGVVWLLTHKPDLTKAAAILDVLIFIIGYDSLRGSNK
QKHIFKKDPTACIWGEPPKVIGGKLLASGYWGISRHCNYLGDLLLAFSFSLPC
GASSFVPYFYPMYLLFLLLWRERRDEAKCREKYKEDWVTYCKLVPWRIIPYL
Y</u>

FIGURE 179: Amino acid sequence of SEQ ID NO: 386. The conserved sterol desaturase family domain is underlined.

MAKLYLFVAALLLLSASSAASQSLNTSSDAIPGKDFSTGKQSVEYLRLFAEDI
SWSNNLVLGLLVPRSIWSPLPRVLQTWLRNYIAGTVVYFVSGSLWSFYIYYW
KRNVYIPADSTPSKEPIFLQIMVTMKAMPLYCALPTLSEYMIENGWTRCYAAI
NEVGWPSYILLTILYLLLVEFGIYWMHRELHDIKVLYKYLHATHHIYNKQNTLS
PFAGLAFNPLDGILQAIPHVIALFIIPTHFLTHELLLFCEGIWTTNIHDCIHGKVW
PIMGAGYHTIHHTTYRHNYGHYTIWMDWMFGTLRDPTAEAKSVKNM

FIGURE 180: Amino acid sequence of SEQ ID NO: 270. The conserved sulfotransferase family domain is underlined.

MQVSQPARPSDPIYRRDDHLSQACKDLVSSLPSEEGWVATSFCLYQGFWF
PTWLFNGVLACQNHFQAQPSDILLVTNPKSGTTWLKAILFALLNRAKYSDSD
SKQRHPLLTQNPHDLVPFLEVKLYLQQENPDLTTFESPRLFATHLPYSSLPG
SVRDSRCKLVYLCRNPKDMFISLWHYVNKRRAEEKGQIPLPKCLDKFCRGL
SPYGPYWDHVMGYHKASLEMPEQVLFLMYEELKEDPRVHVSRLADFLGCP
FSDEELRDGTVEGIMRMCSFDNLSSLEVNKSGKLWTGQENQWFFRRGKVG
DWVNYLSAEMADKIDQVMEEKLRDSGLNFQYK

FIGURE 181: Amino acid sequence of SEQ ID NO: 276. The conserved sulfotransferase family domain is underlined.

MQPSQPPPLNENYLRDDVKSQECEDLHSSLPSEEDWVPTSLPSEEDCVPS
TLRLYQGFWFPSWVLNSVVACQNHFQAH<u>PSDILLVTSPKCGTTWLKAILFAL</u>
<u>LNRAKYSDSNSQKRHPLLTQNPHDLVPFLEFRLYLQNKNPDLTAFASPRLLA</u>
<u>THLPYSSLPRSVRDSNCKLVYLCRNPKDTFISMWHYFNKLRPEEKGQLPLP</u>
<u>EGLDKFCRGVNWCGPYWDHVLGYHKASSEMPEKVLFVKYEEMKADPSVQ</u>
<u>VRRLADFMGRPFSEEELRNGTVEGILRMCSFDNLSALEVNRSGKLPSGLEK</u>
<u>KWFFRKGEVGDWVNYMSAEMGEQIDGVMEEKLHGSGLKF</u>

FIGURE 182: Amino acid sequence of SEQ ID NO: 282. The conserved sulfotransferase family domain is underlined.

MAHQQLCSQSAIAGTEEHERKETDELIASLPQRKGAVRPFQCLYQNFWSPIF
VLPNVITFQRHFEAKHKDIVLASQPKSGTTWLKALVFSIVNRFRFGISNTPLLT
SNPHELVPFFEFQLYGSKLRPNLDGLAEPRLFATHIPYPSLPECIKRSECQIIY
ICRNPLDTVVSSWHFFLEKARLEDQPEWSLEEHFETYCQGTISFGPFWDHI
MGYWKMSLEWPSKVLFLKYEDLKEDTVVHLNRVAEFVGLPFTEEEEEAGVI
EEIAKMCSLKTLKDLEVNKSGKVALTIEFEKRSFFRKGEVGDWVNHLTPSMV
DRLNSIIQEKMSPFGLEFKTC

FIGURE 183: Amino acid sequence of SEQ ID NO: 339. The conserved sulfotransferase family domain is underlined.

MAVVASNSLQLQREEEAETMISDQQQEAGAEIMASEEESIMEPENPSLSHP
NIVSSCGMRFQKY<u>QSVWIDANLVPAVNFIQNEFQPRPDDIFFASLPKTGTTW
GKALLYTILEFTSTGNNPPASPNGNSAADEKRFGVDEKNPHALVPTMETYLF
NSSDSEQYDISCFSDFPSPRVLHTHLPIHTLPLLVRSSPTCKIVYIARNPRDSF
VSLWQFYARLRGAGSHYLDGDLGKETVFDAFCSGFYYGGPFAENVLSYWH
ESRRNPNQVMFVTYEDLQADCVGWVKRMALFLGCSSPLLEDNAQIIAEKCS
FDTLCNLQVNRKGKVGTLKYGMKNAFFFREGKVGEWKKHFTPQMEERIYLE
IEQK</u>LSDQGLRFTNSL

FIGURE 184: Amino acid sequence of SEQ ID NO: 246. The conserved Synaptobrevin domain is underlined.

MVKLTMIARVTDGLPLAEGLDDGRDVKDAEFYKQQVKALFKNLSKGQNEPS
RMSVETGPYYFHYIIEGRVCYLTMCDRSYPKKLAFQYLEDLKNEFGRVNGA
QIETAARPYAFIKFDTFIQKTKKLYQDTR<u>TQRNISKLNDELYEVHQIMTRNVQ</u>
<u>EVLGVGEKLDQVSEMSSRLTSESRIYADKARDLNRQALIRKWAPVAIVLGVV</u>
<u>FLLFWVKSKIW</u>

FIGURE 185: Amino acid sequence of SEQ ID NO: 249. The conserved Synaptobrevin domain is underlined MGQQSLIYSFVARGPVLLAEYTEFSGNFTSVASQCLQKLPATSNKFTYNCD
GHTFNYLVDDGLTYCVVAVESVGRQIPMAFLERIKEDFTHRYDAGKAATASA
NSLNREFGPKLKEHMQYCVDHPE<u>EISKLAKVKAQVSEVKGVMMENIEKVLD
RGEKIELLVDKTDNLRSQAQDFRQQGTKMRRKMWLQNMKIKLIVLGIIIALILV
IVLSVCHGFNCGHK</u>

FIGURE 186: Amino acid sequence of SEQ ID NO: 251. The conserved Synaptobrevin domain is underlined MSQKGLIYSFVAKGTVVLAEHTQFSGNFSTIAVQCLQKLPSNSSKYTYSCDG
HTFNFLTDSGFVFLVVADESVGRSVPFVFLERVKDDFMQHYSASIASGDPH
PLADDDEDDDLFQDRFSIAYNLDREFGPRLKEHMQYCMSHPE<u>EMSKLSKLK
AQISEVKGIMVDNIEKVLDRGERIELLVDKTENLQFQADIFQRQGRQLRRKM
WFQNLQMKVVVAGAVVIVIFLLWLIAKW</u>GSK FIGURE 187: Amino acid sequence of SEQ ID NO: 254. The conserved Synaptobrevin domain is underlined MGEESFIYSFVARGTMILAEYTEFTGNFPAIAAQCLQKLPSSNNKFTYSCDH
HTFNFLLEDGYAYCVVAKESVAKQISIAFLERVKVDFKKRYGGGKADTAVAK
SLNKEFGPIMKEHMKYIIEHAE<u>EIDKLIKVKAQVSEVKSIMLENIDKAIDRGENL
TILADKTENLRDQAQAYKKQGTQIRRKMWYQNMKIKLVVFGILLFLILVIWLSI
CHGFDCSN</u>

FIGURE 188: Amino acid sequence of SEQ ID NO: 277. The conserved synaptobrevin domain is underlined.

MAILYAVVARGTVVLAEFSAVTGNTGAVARRILEKLPSEADSRLCFSQDRYIF
HILRSDGLSFLCMANDTFGRRIPFSYLEDIQMRFMKNYGKVAHFAPAYAMND
EFSRVLHQQMEFFSSNP<u>SADTLNRVRGEVSEMRTIMVDNIEKILDRGDRIEL
LVDKTATMQDGAFHFKKQSKRLRRALWMKNAKLLALLTCLILVLLYIIIAACCG
GITLPNCRS</u>

FIGURE 189: Amino acid sequence of SEQ ID NO: 295. The conserved Synaptobrevin domain is underlined and the Synaptobrevin signature is in bold.

MFTISTCTTHAQSLIYSFVARGTVVLAEYTEFKGNFTGIAAQCLQKLPASNNK
FTYNCDNHTFNYLVEDGFAYCVVADESVGRQVPMAFLERVKEDFKRRYGG
GRADTAVANSLNRDFGSKLKEHMQYCIDHPE<u>EISKLAKVKAQVSEVKGVMM</u>
<u>DNIEKVLDRGEKIELLVDKTENLRFQAQDFQKKGTELRRKMWFQNMKVKLI</u>
<u>VLGIVVALILIIVLSVCHGFNCSKK</u>

FIGURE 190: Amino acid sequence of SEQ ID NO: 321. The conserved synaptobrevin domain is underlined.

MVKLTMIARVTD

FIGURE 191: Amino acid sequence of SEQ ID NO: 337. The conserved synaptobrevin domain is underlined.

MVDHSLIYSFVSRGTVILAEYTEFTGNFPTIAFQCLQKLPATSNKFTFDCQHH
TFNYLVEDGFTYCVVADESAGRQVPMAFLERIKDEFKKTYSDGRAEVAIANG
LHQEFGPKLKEHMDYCAQHPE<u>QINKLAKTKAQVAEVKGVMMDNIEKILDRG
EKIELMVDKTEQLQFQAQDFQNQGAKIRRKMWFRNTKVKLICLSFLLFVVLMI
WISLCRGFKCHV</u>

FIGURE 192: Amino acid sequence of SEQ ID NO: 338. The conserved Synaptobrevin domain is underlined and the Synaptobrevin signature is in bold.

MAILY

FIGURE 193: Amino acid sequence of SEQ ID NO: 340. The conserved synaptobrevin domain is underlined and the synaptobrevin signature is in bold.

MGQQSLIYSFVARGTVVLAEYTQFTGNFTTIANQCLQKIPASNNKFTYNCDR
HTFNYLVEDGYTYCVVADESVGRQLPIAFLERIKDDFKKRYGGGKADTAVAH
SLNKDFGPKLKDHMQYCVDHPE<u>EINKLAKVKAQVSEVKGVMMENIEKVLDR</u>
<u>GEKIELLVDKTENLRFQAQDFQKQGTQLRRKMWFQNMKVKLVVLGIVFVLIL</u>
<u>IIWLSICH</u>GFKCH

FIGURE 194: Amino acid sequence of SEQ ID NO: 352. The conserved Synaptobrevin domain is underlined and the Synaptobrevin signature is in bold.

MAQQSLIYSFVARGNIVLAEHTSFSGNFSIIAVQCLQKLPSNSNKFTYTCDNH
TFNYLVDDGFVFLVVADEAAGRQVPFIFLERVKEDFKRRYGGRAETSMAHS
LDKDYGPILRDHMQYCMDHPE<u>ELSKFFKIKAQVSEVKGIMMD**NIEKVLDRGE
KIELLVDKTE**GLQFQADNFQRQGRQLRRKMWLQNLKFKLIVLGIVLVIMLIIW
LSICKGFSCH</u>

FIGURE 195: Amino acid sequence of SEQ ID NO: 379. The conserved Synaptobrevin domain is underlined and the Synaptobrevin signature is in bold.

MAILYALVGRGTVVLAEFSAVGGNAGTVARRIMEKLPLQDRGEGESRLCYS
QDRHIFHILRGSDGLTFLCMANDTFGRQIPFAYLEDIQMRFMKTYGRVAQNA
LAYAMNDEFSRVLHQQMEYFSSNP<u>NADTLTRVGEMNEVRTVMVENIEKIL</u>
<u>ERGDRIELLVDKTSTIQDSSFHFKKQSRRLRQALWMKNAKLLASLTCLIVVLL</u>
<u>YIIIALCCGGITLPSCRS</u>

FIGURE 196: Amino acid sequence of SEQ ID NO: 391. The conserved Synaptobrevin domain is underlined.

MMESLRKLVYYACVSRGPVIVAEYNDLGDAEQLAIAVECLGRAPPFHSRFTH
TIKNRRYSFLMDSEFVYYAIVDEALPKVKVFSFLEQVRDEFKRLLRAKGLSNS
KDEILQGCGLGDDFASTFRRLVAPLVGIPQTEKRRMEEEEASARRQEDETE
TEVCSPTASAPLYGKPQPDSKPKKDKKSLCSIPPLILKT<u>NKHEKKKVRDQVT
QVREIIMESSGKALDNGQKLEVTVDGNTGGAAALSLQRTASMRTKGQQIAQ
RMWWRNVRVVLLLDFVVCTILFVVWLCICR</u>GFKCVSD

FIGURE 197: Amino acid sequence of SEQ ID NO: 371. The two cellular retinaldehyde triple function c-terminal is underlined and the phosphatedylinositol transfer proten-like n-terminal is italic.

M*GSSGRHENEAEKVVSCYEGDTIEQNRVDLMRSIIEVKYPSAKVTDDATLRR*
*FLRARDLNVEKASQLFLKYLKWRQALVPLGYIPE*<u>SEVSNELRKKKVYIQGFD</u>
<u>KQRRPIEVILTARHYASDRDLEEFKRLIVYGFDKLCASMPTGLETFVVIADFE</u>
<u>GWGYSNMDTRAYLAALEILQDCYPERLAKAFMIHVPYLFQTAWKMISPFID</u>
<u>KVTKKKIIFVEDKHLRSTLLNDIDESQLPEIYGGALPLVPAQDFVIPNWS</u>

FIGURE 198: A graphic representation of the DNA construct pWVR202.
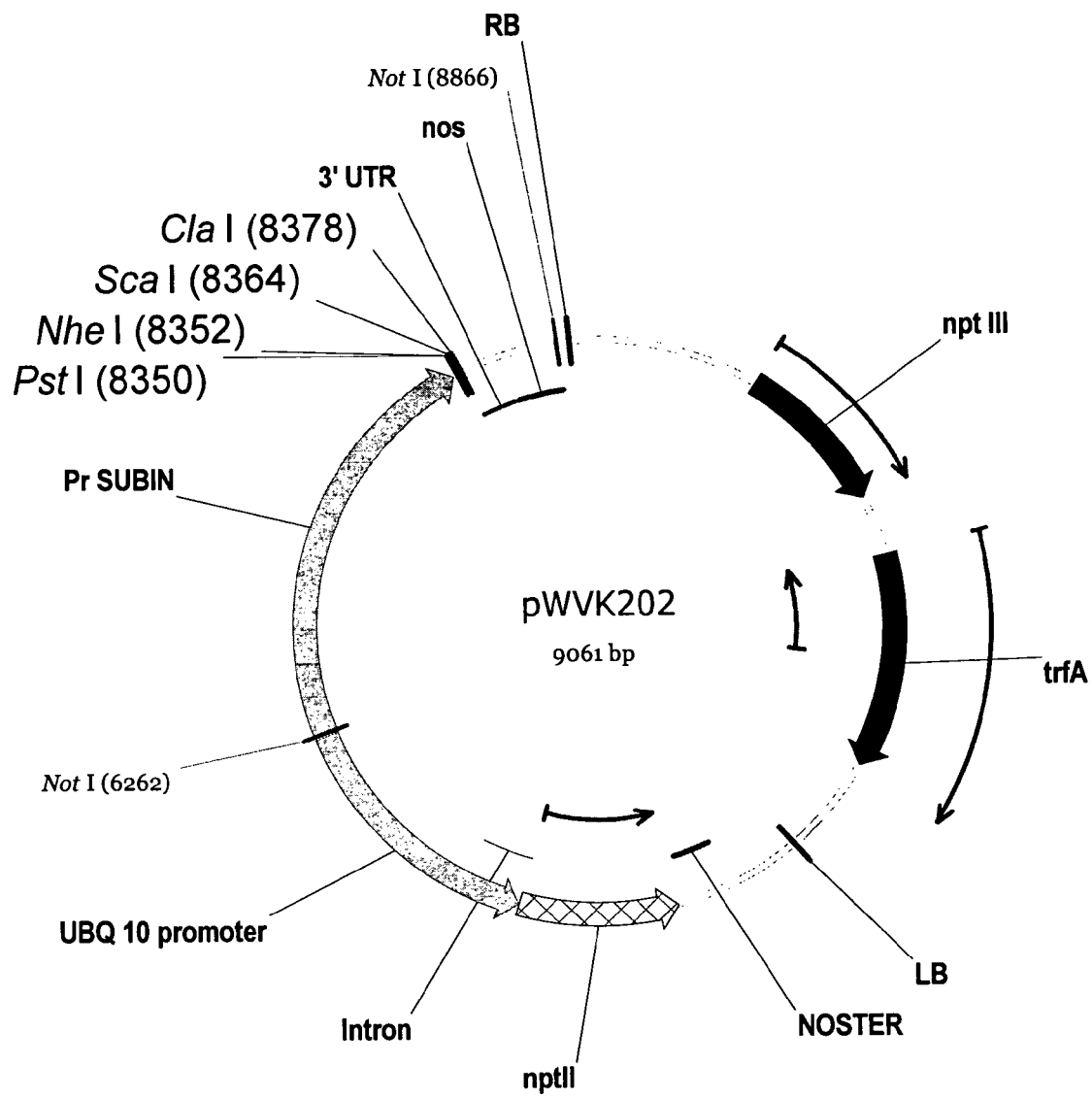

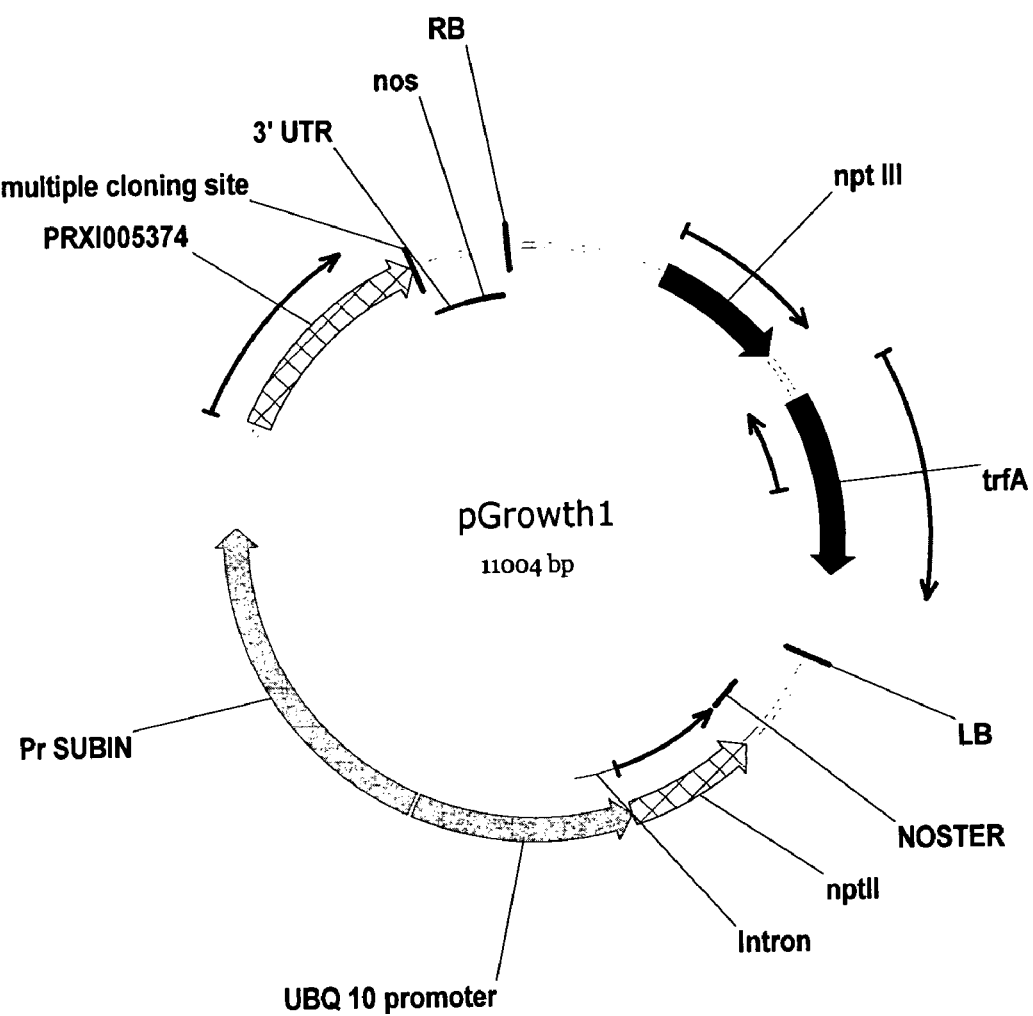
FIGURE 199: A graphic representation of the DNA construct pGrowth1.

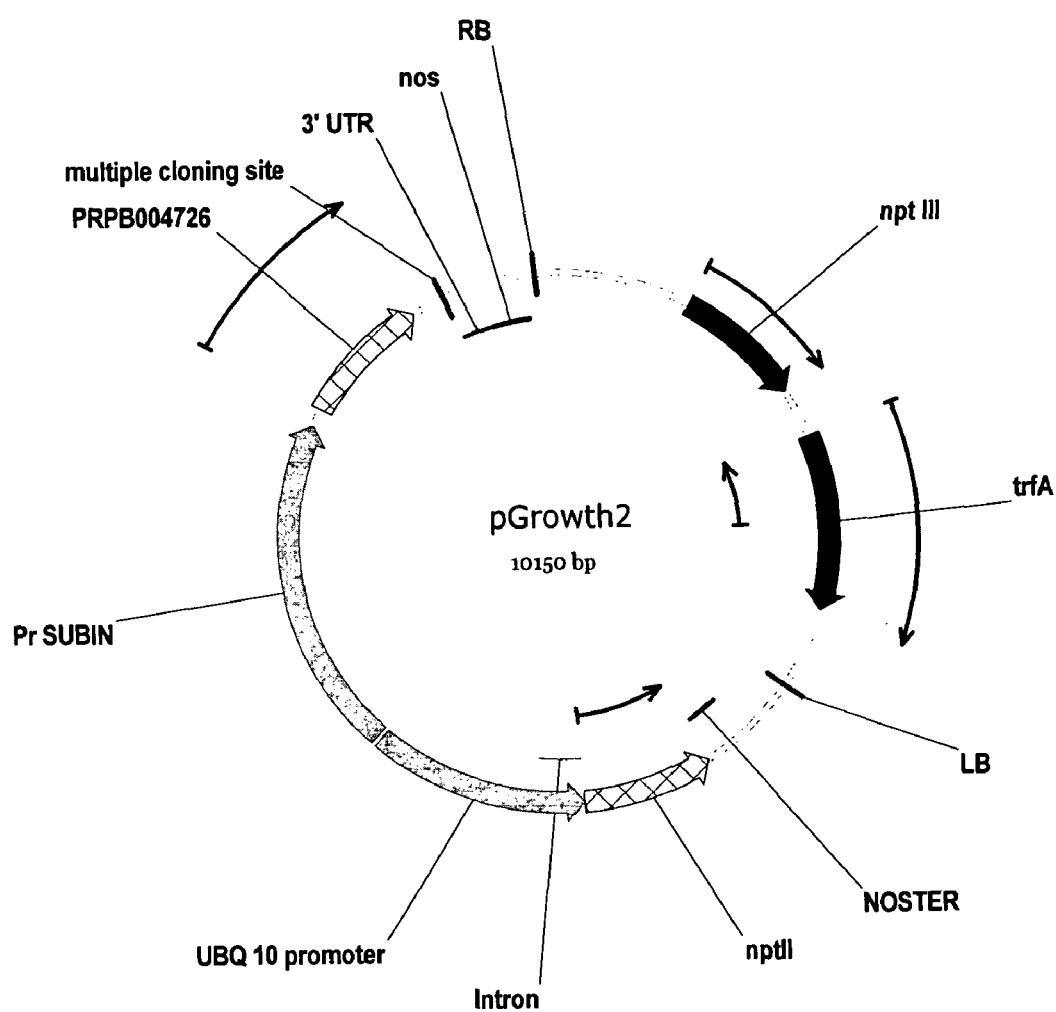
FIGURE 200: A graphic representation of the DNA construct pGrowth2.

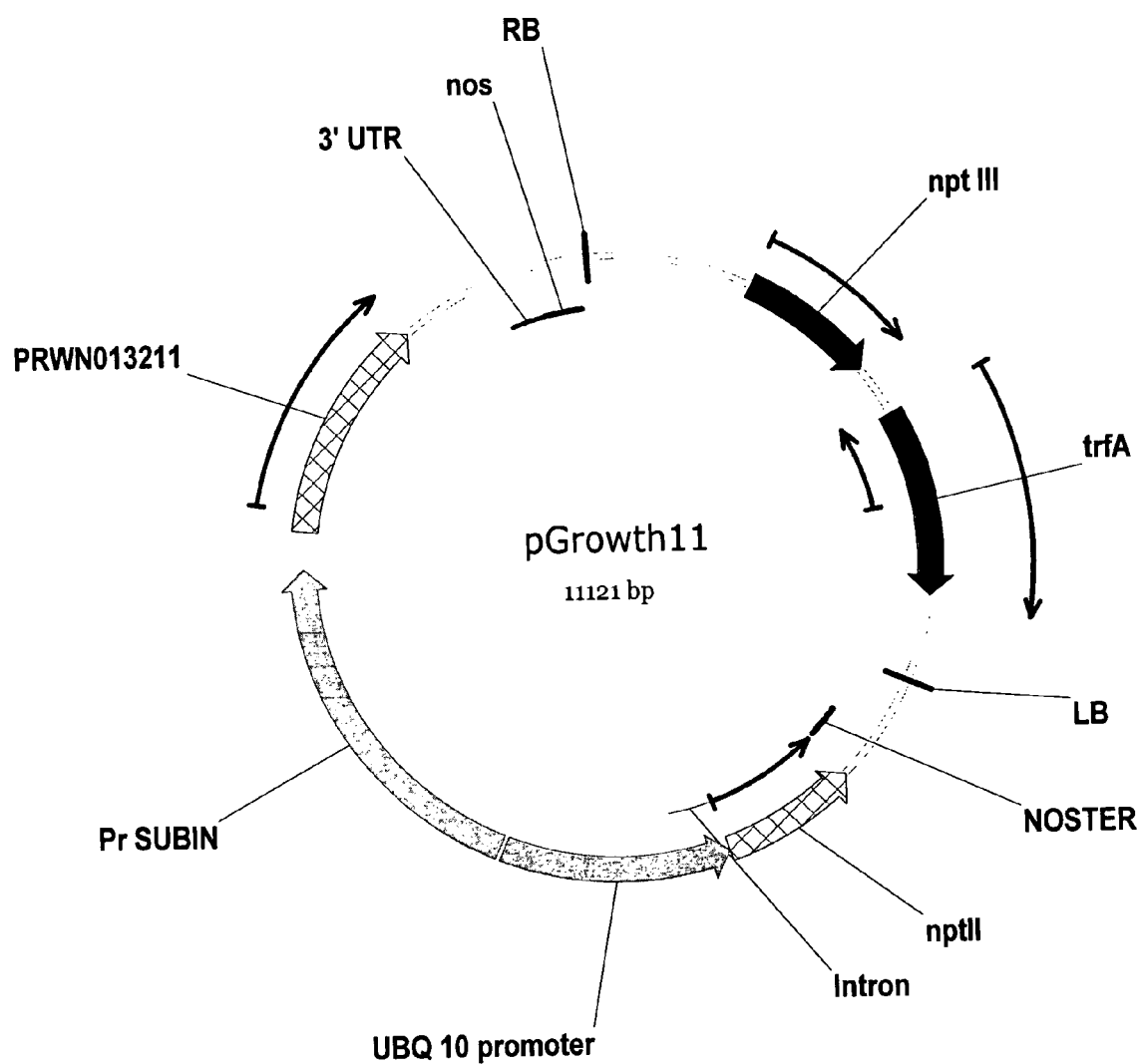
FIGURE 201: A graphic representation of the DNA construct pGrowth11.

FIGURE 202: A graphic representation of the DNA construct pGrowth21.
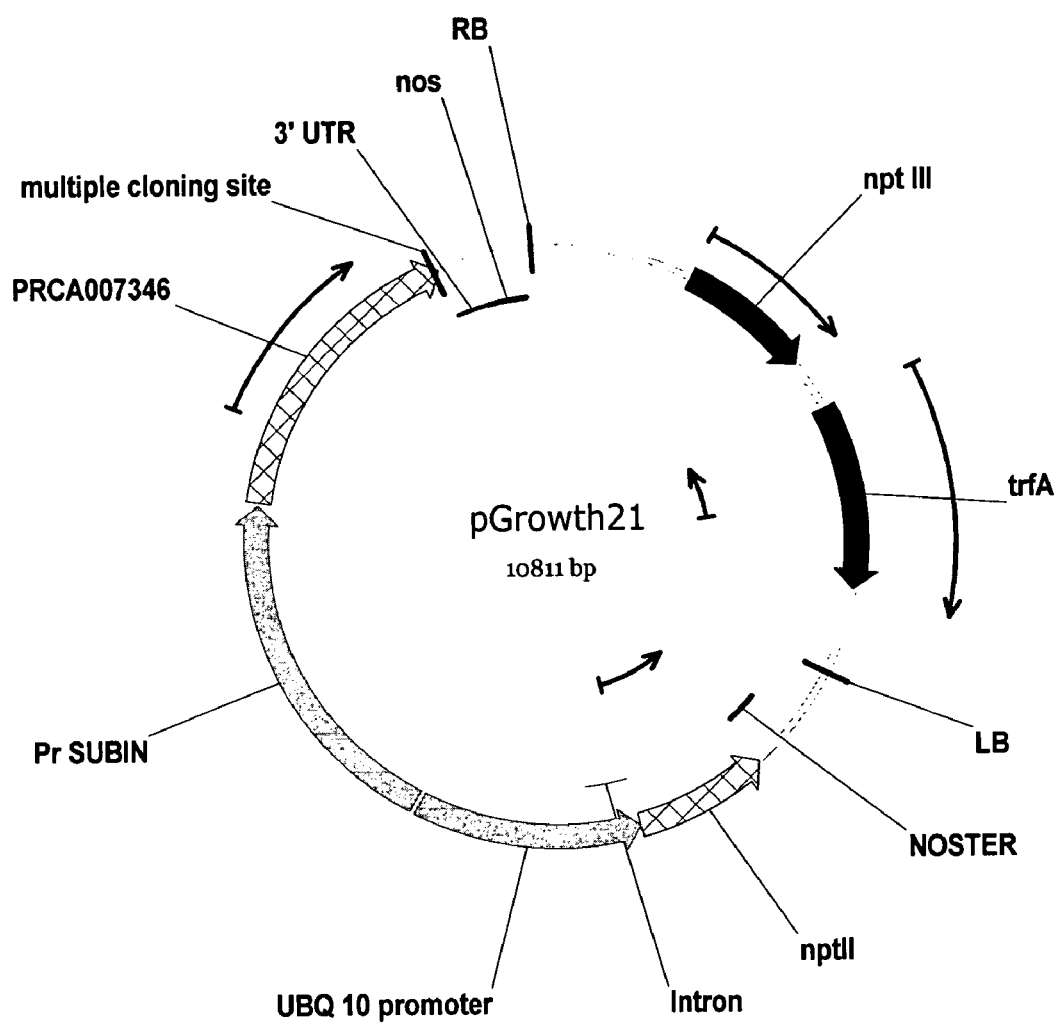

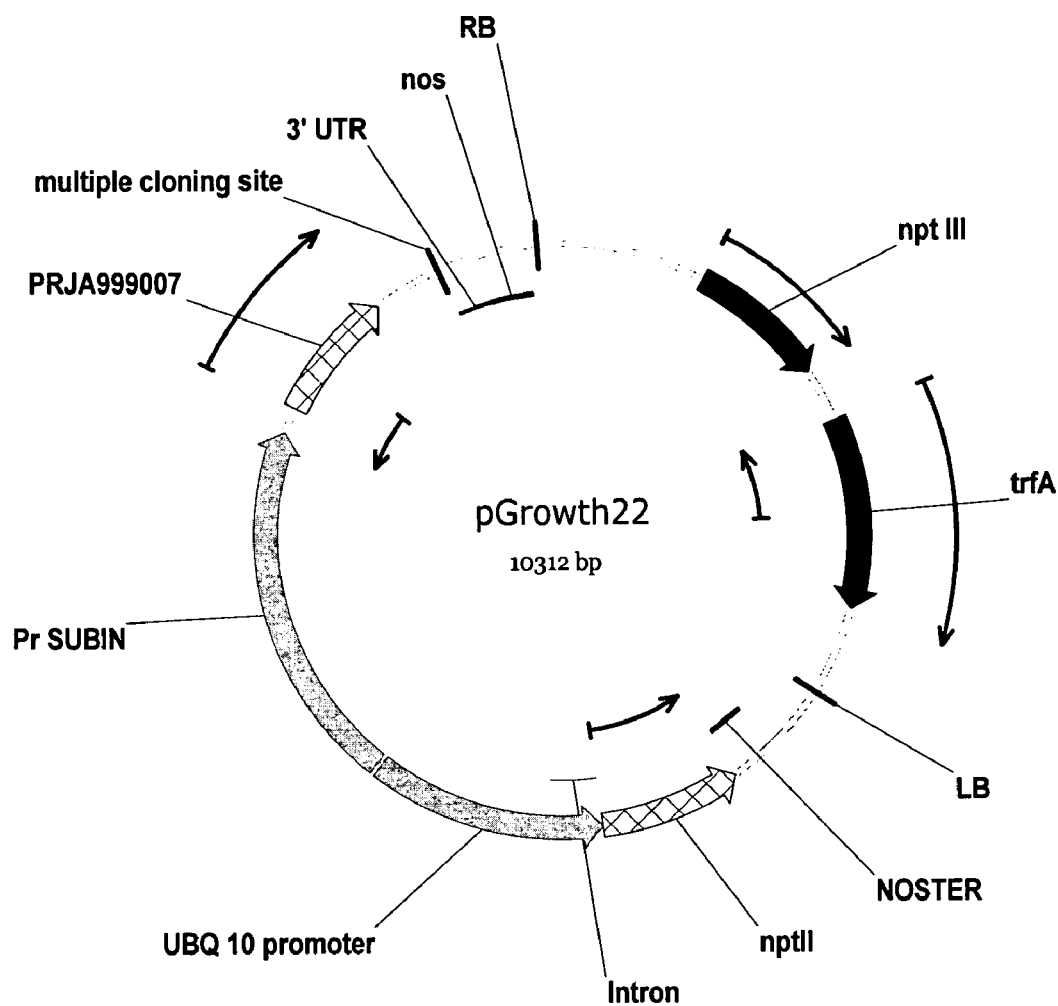
FIGURE 203: A graphic representation of the DNA construct pGrowth22.

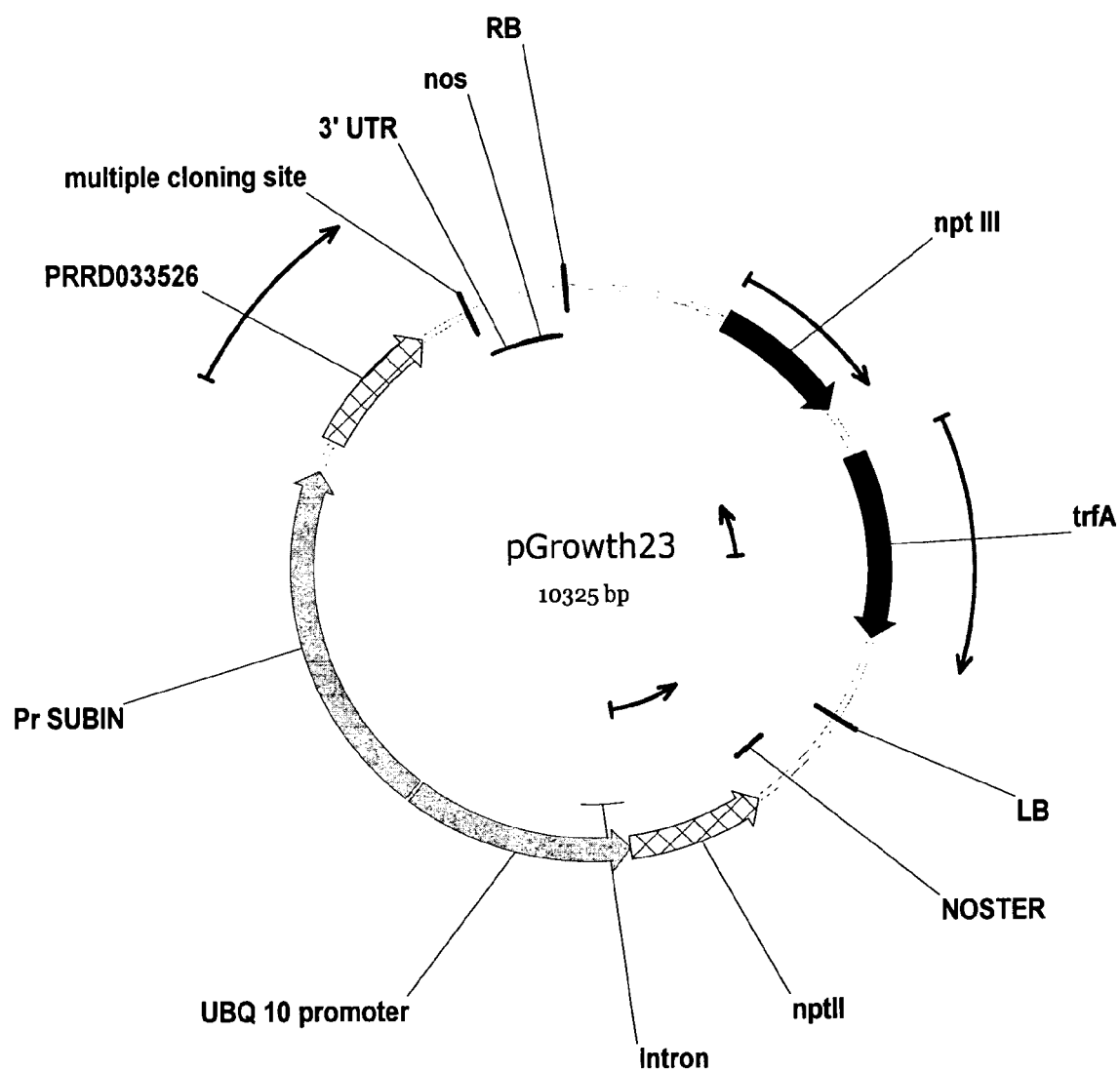
FIGURE 204: A graphic representation of the DNA construct pGrowth23.

FIGURE 205: A graphic representation of the DNA construct pGrowth24.
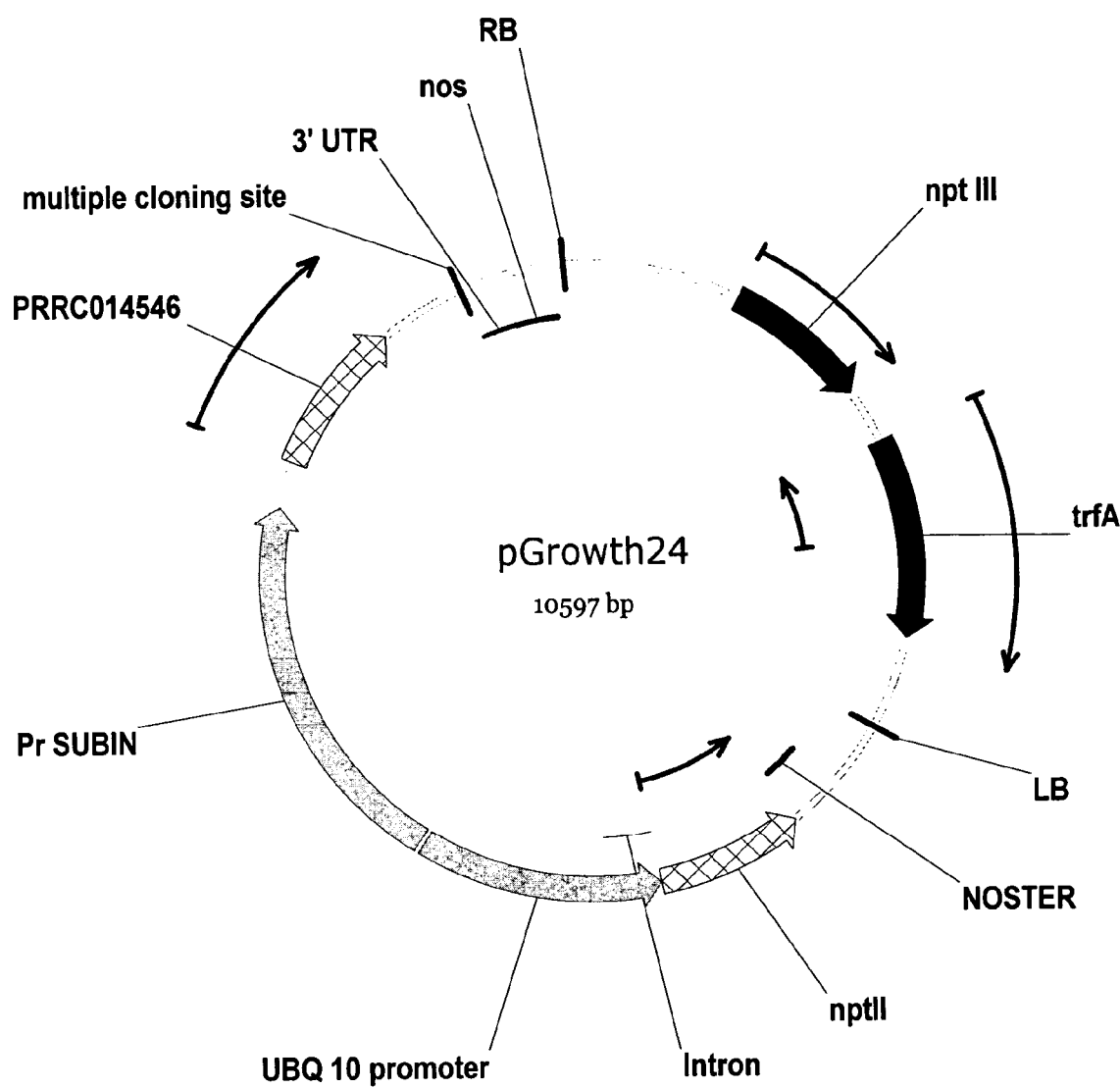

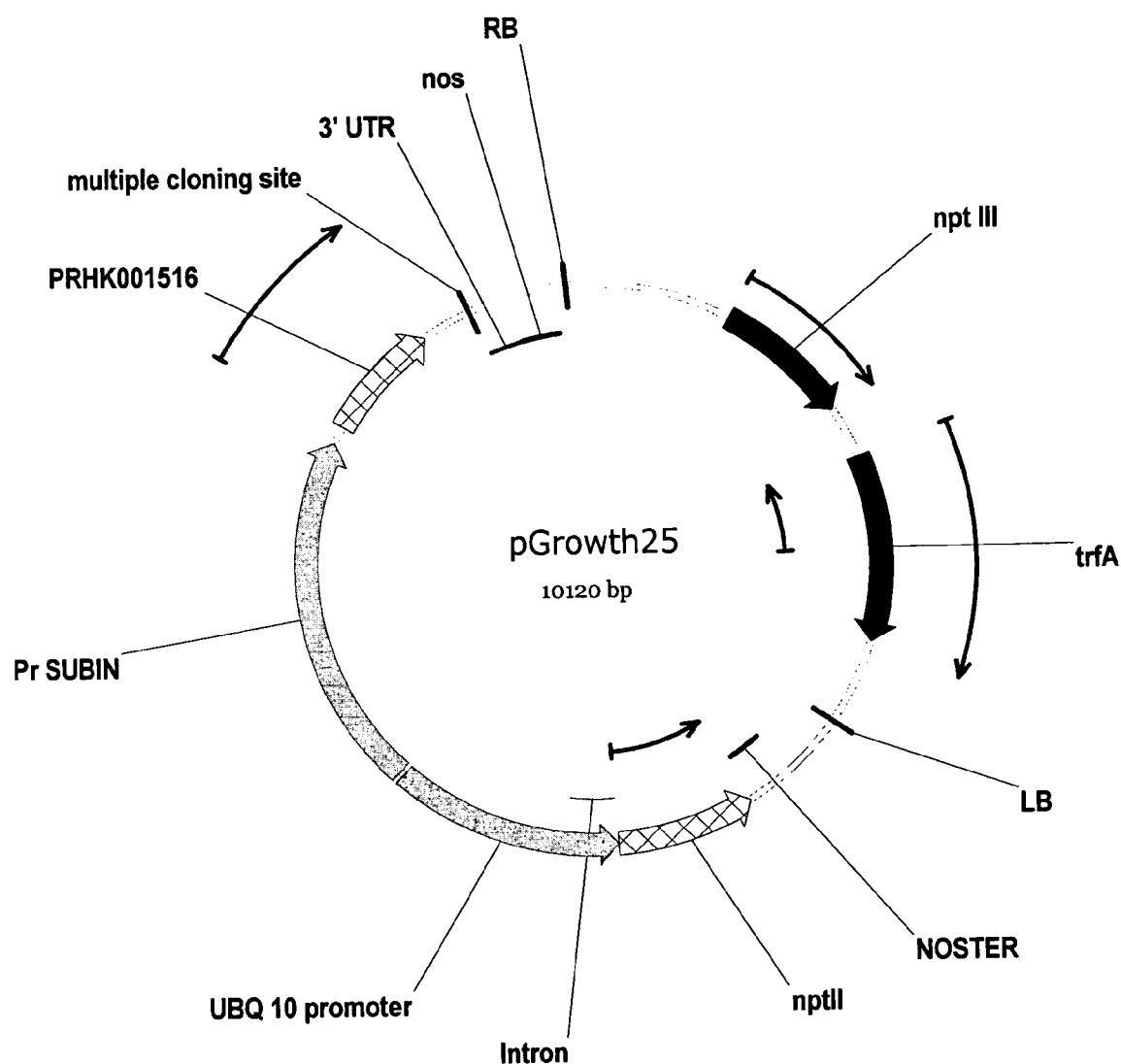
FIGURE 206: A graphic representation of the DNA construct pGrowth25.

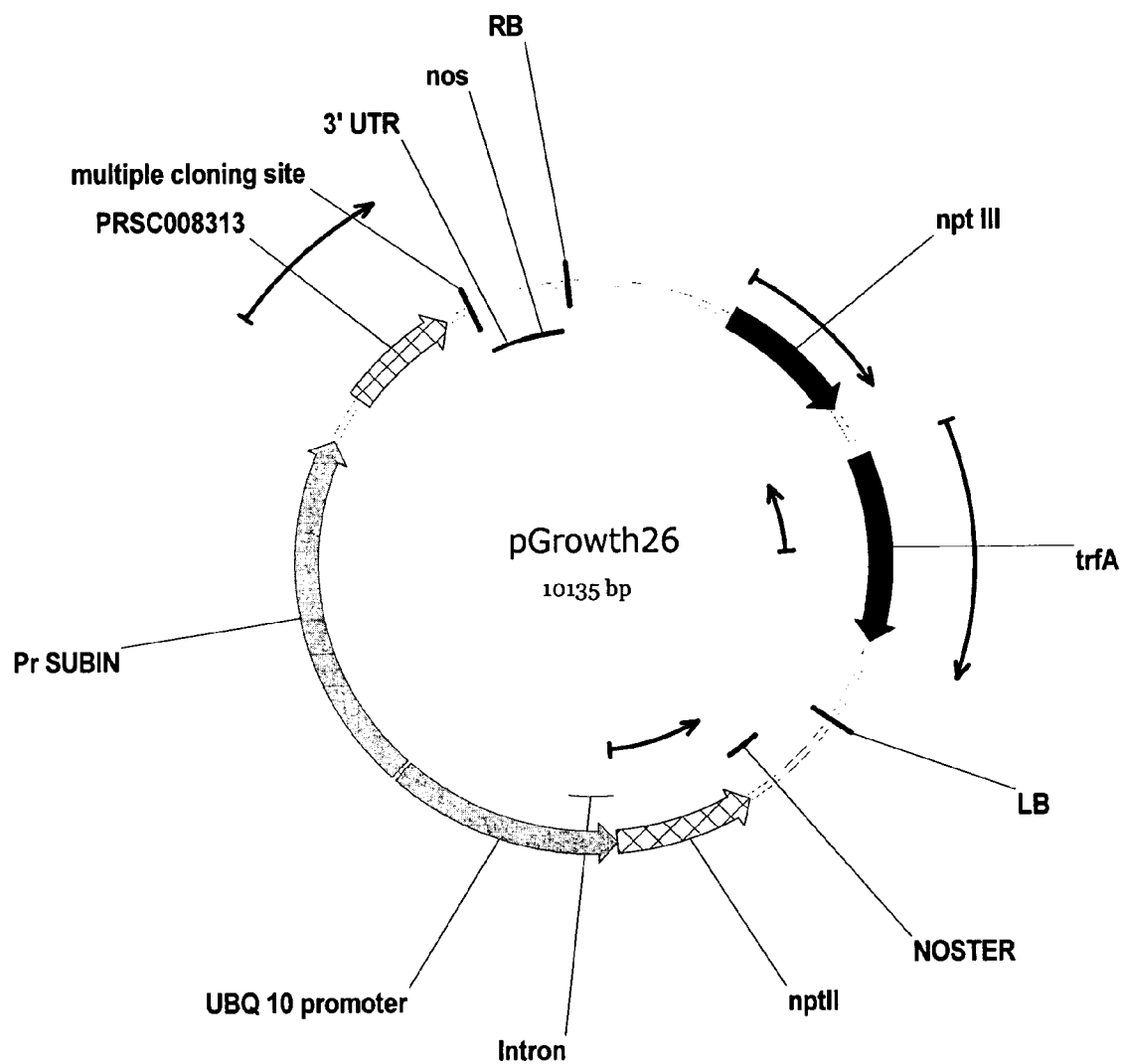
FIGURE 207: A graphic representation of the DNA construct pGrowth26.

FIGURE 208: A graphic representation of the DNA construct pGrowth27.
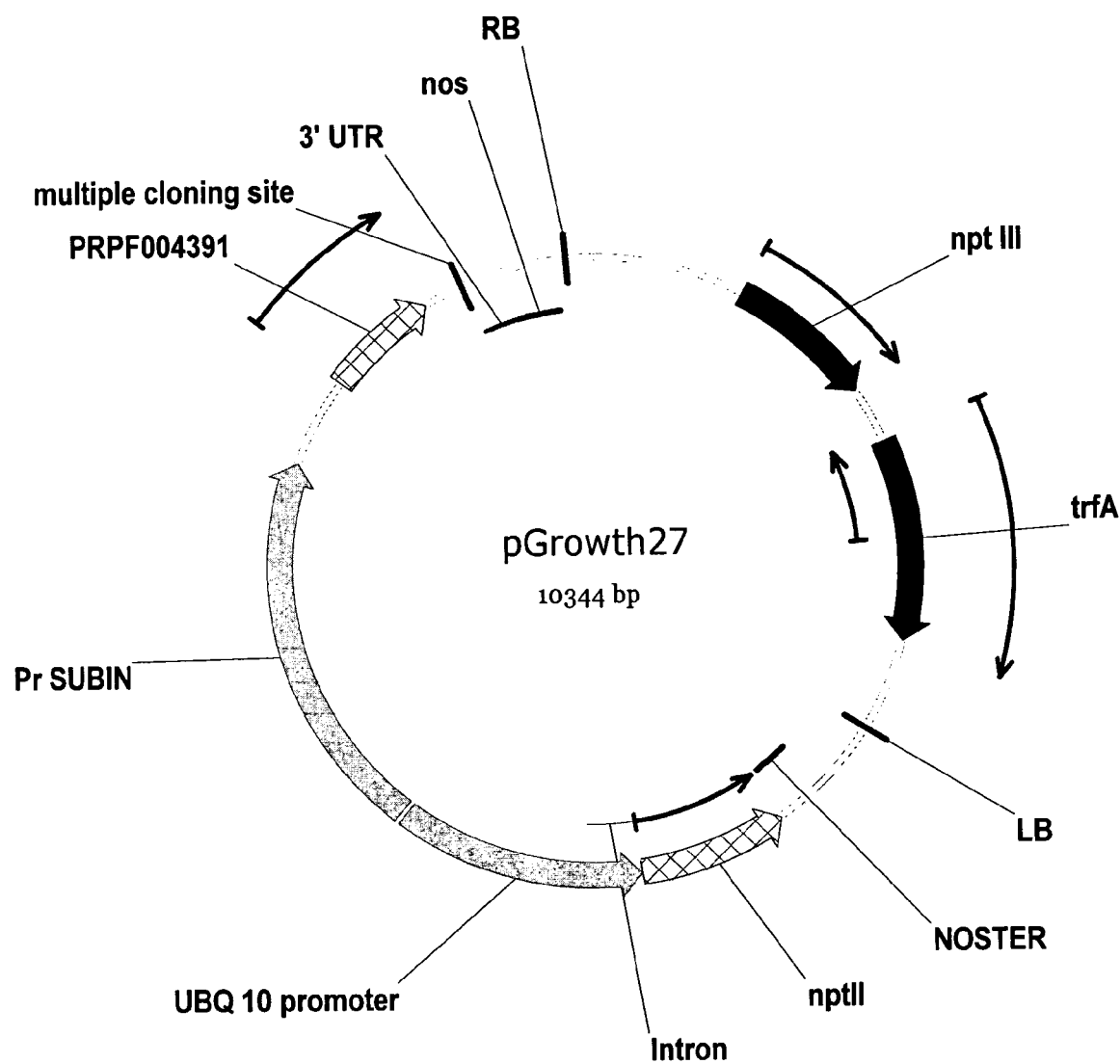

FIGURE 209: A graphic representation of the DNA construct pGrowth28.
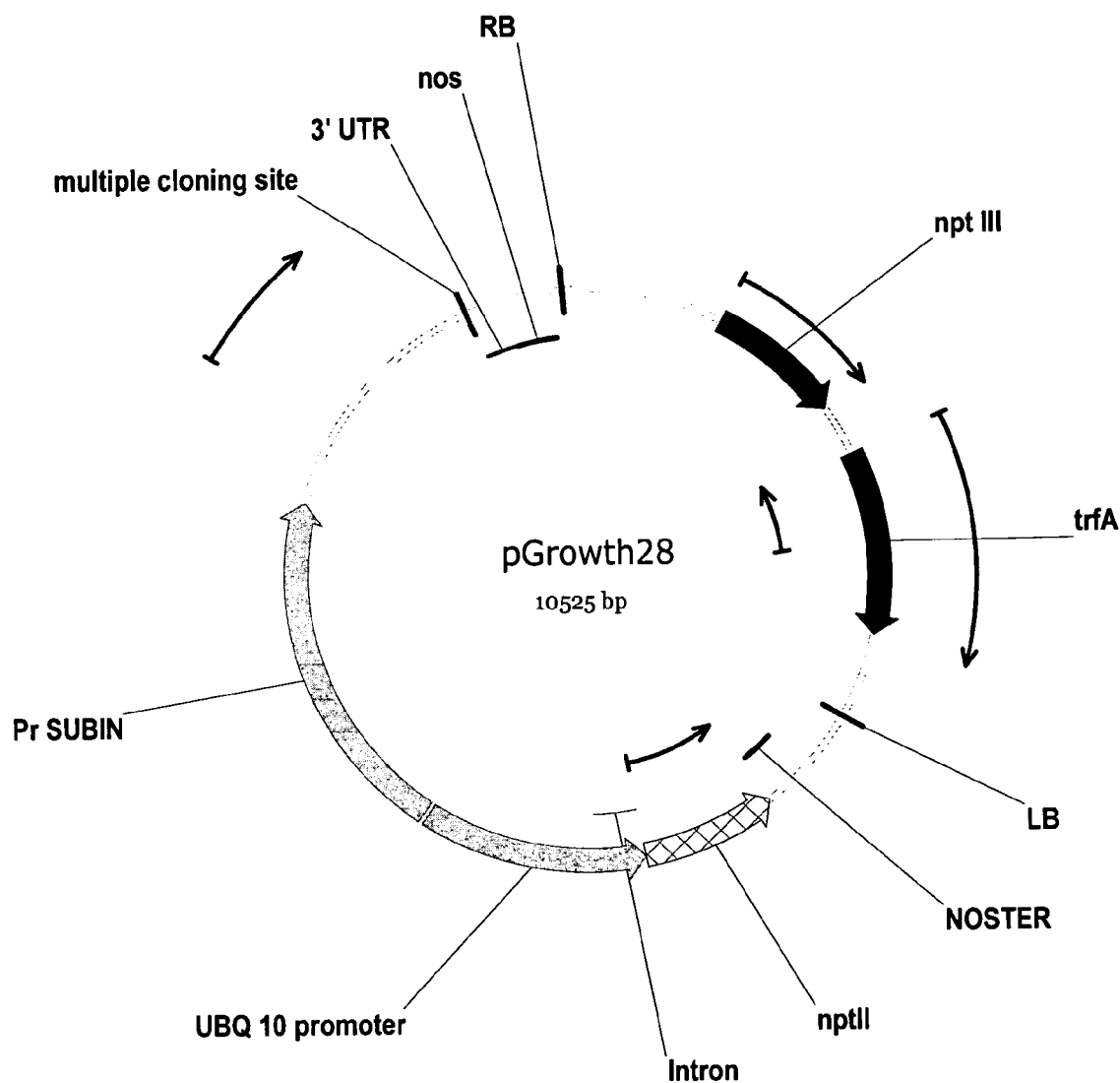

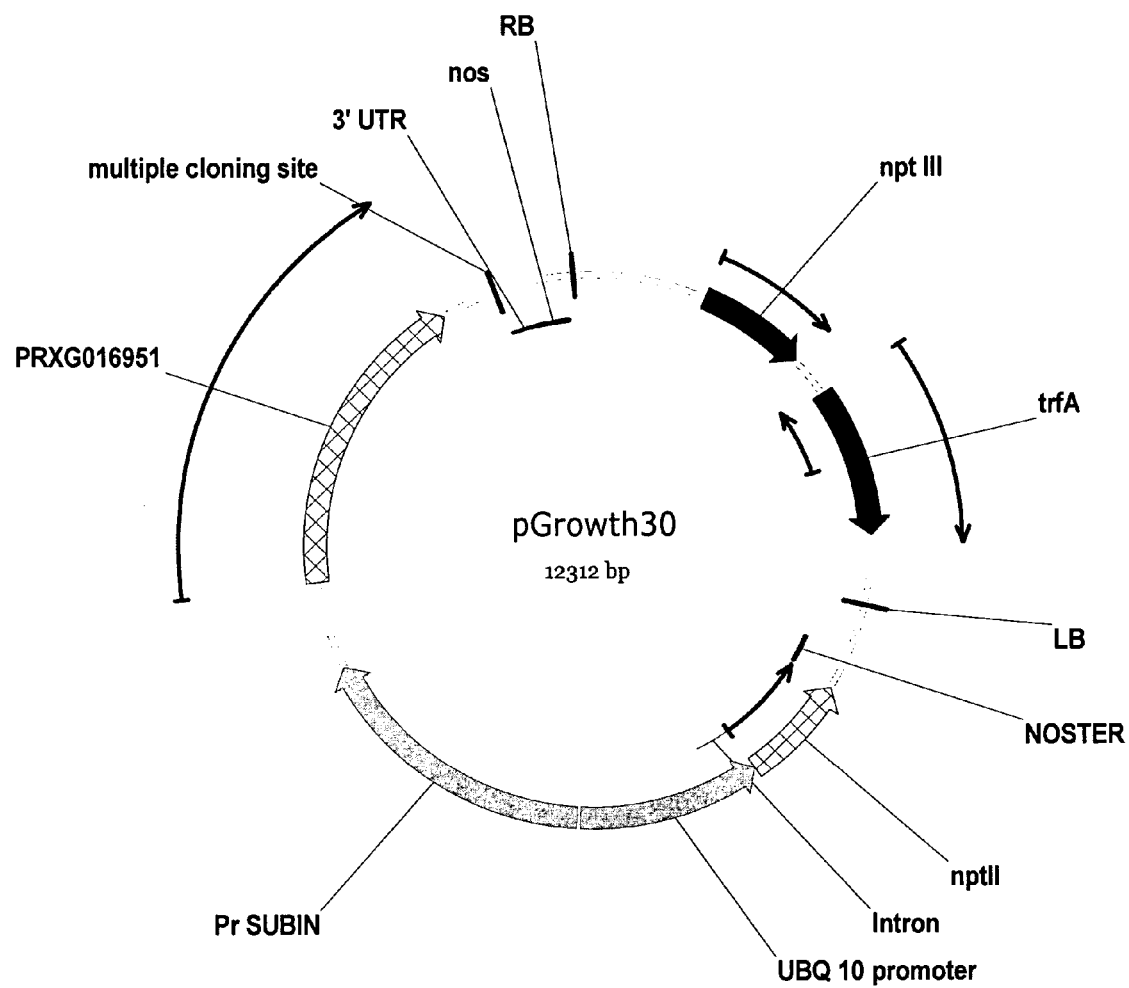
FIGURE 210: A graphic representation of the DNA construct pGrowth30.

FIGURE 211: The percentage of shoot lines from each line of plants transformed as described in Example 16.
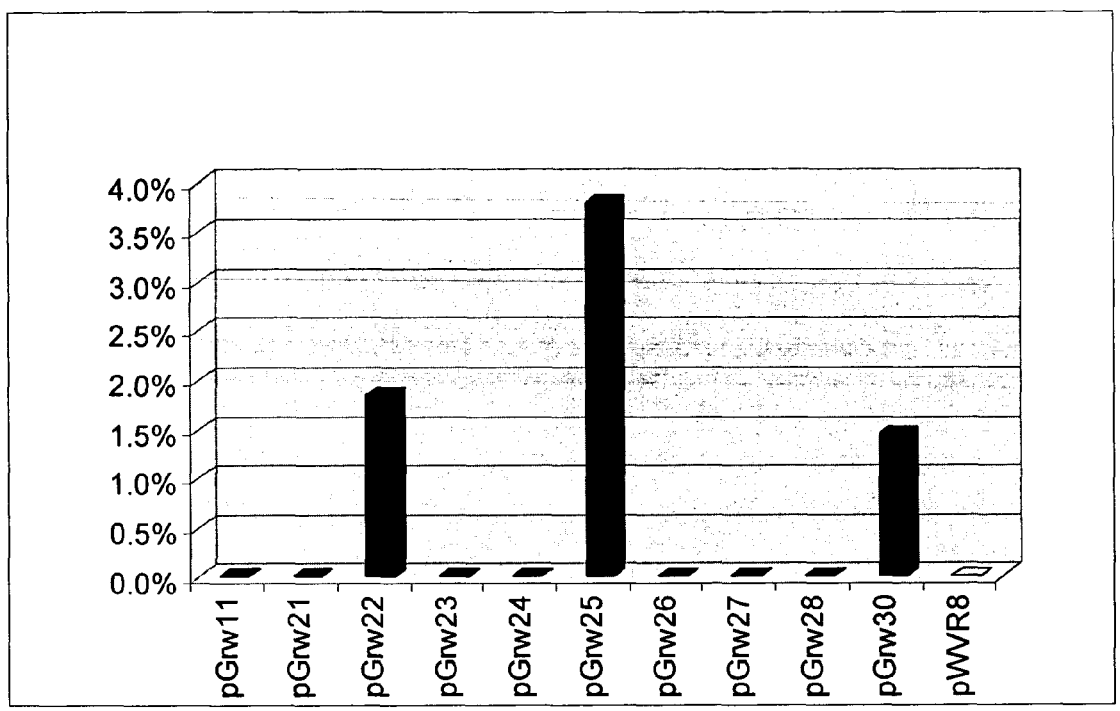

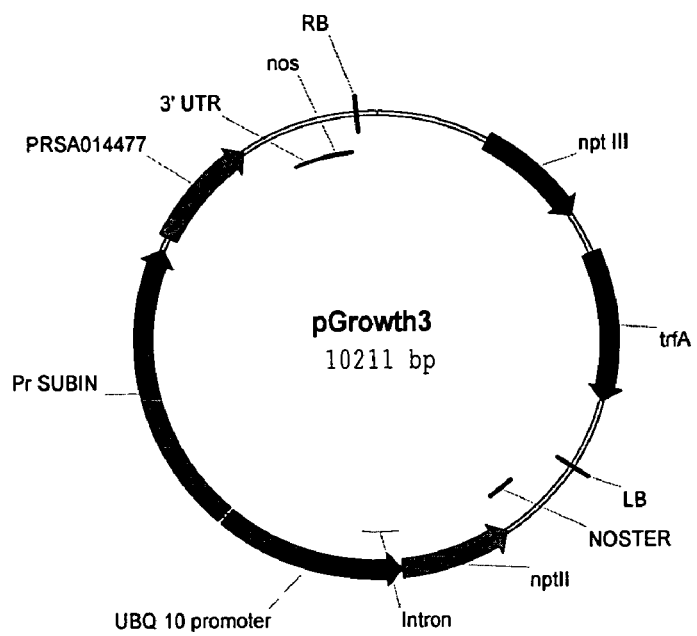
FIGURE 212: A graphic representation of the DNA construct pGrowth3.

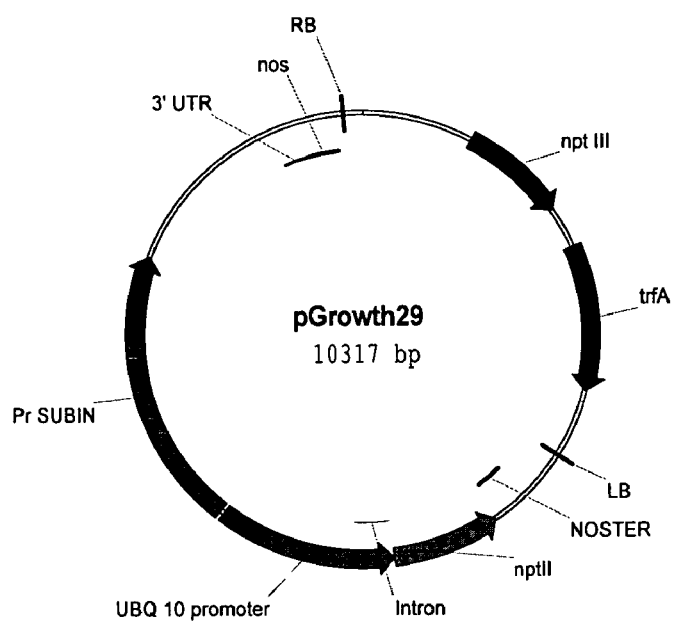
FIGURE 213: A graphic representation of the DNA construct pGrowth29.

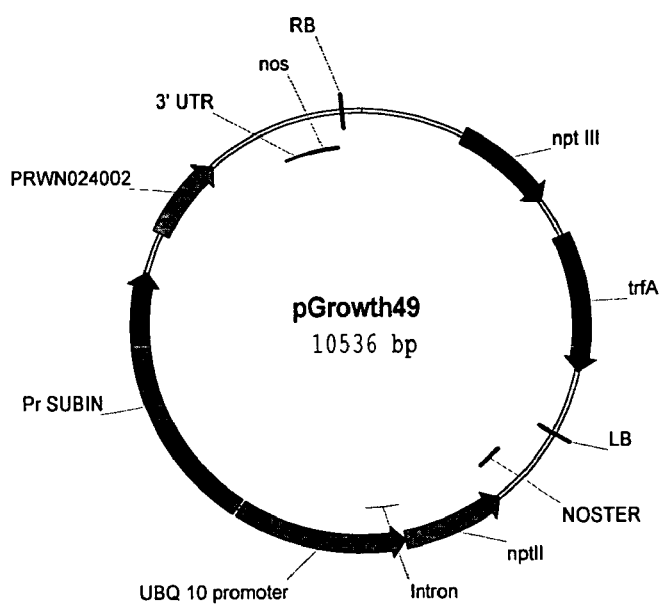
FIGURE 214: A graphic representation of the DNA construct pGrowth49.

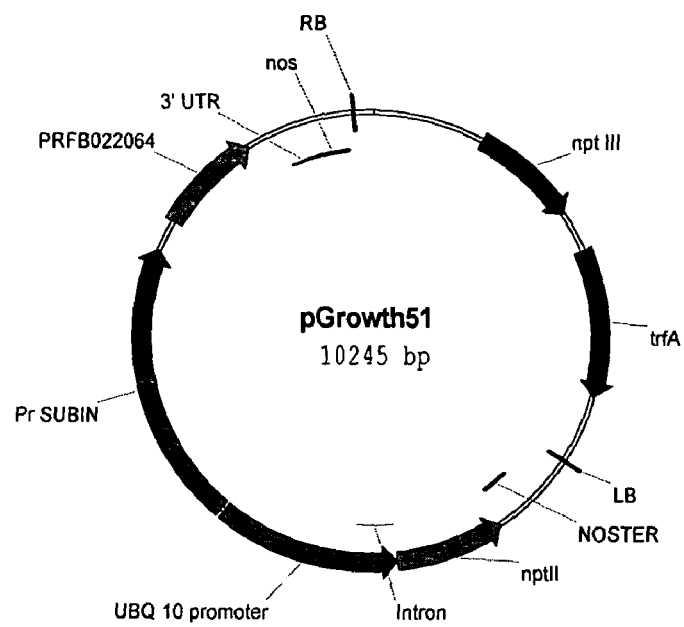
FIGURE 215: A graphic representation of the DNA construct pGrowth51.

PLANT CELL SIGNALING GENES

BACKGROUND

1. Field of the Invention

Sequence Listing

The instant application contains a Sequence Listing which has been submitted via EFS-Web and is hereby incorporated by reference in its entirety.

The present invention relates generally to the field of plant cell signaling genes and polypeptides encoded by such genes, and the use of such polynucleotide and polypeptide sequences for controlling plant phenotype. The invention specifically provides cell signaling polynucleotide and polypeptide sequences isolated from *Eucalyptus* and *Pinus* and sequences related thereto.

2. Background

A. Cell Signaling Genes and Gene Products

Plants progress through set developmental programs throughout the course of their lifetimes. This is particularly evident in embryogenesis and floral development. There are a variety of signal molecules produced by certain cells in the plant to which other cells, particularly in the meristematic regions, are poised to respond. These signal molecules trigger distinct sets of developmental programs at specific times that lead to the formation of, for example, flowers or cotyledons. In addition to the programmed developmental pathways, plants are exposed to a variety of environmental stimuli such as changes in temperature and amount of sunlight, availability of water, wounding from mechanical injury and attack by pathogens. Environmental factors, such as exposure to light, heat, cold, drought, etc., activate the expression of genes and synthesis of proteins and other compounds essential for an appropriate response to the environmental signal and thereby, the healthy development of the plant. These responses, like the developmental pathways, are mediated by signal molecules.

To respond to these signal molecules, plant cells produce surface receptor proteins that serve as sensors, regulators and/or transducers of cell signals. The intracellular transduction of a signal is often transmitted via a phosphorylation cascade of molecules that culminates in the transcription of genes to elicit the appropriate cellular response either for normal development or against environmental challenge.

One major class of receptor proteins is the single-transmembrane family, of which there are several subclasses. These proteins are characterized by three domains: an extracellular signal molecule (or ligand) recognition/binding domain, a single cell membrane-spanning domain and an intracellular signal transduction domain which is usually a protein kinase. Many, but not all, plant single transmembrane proteins belong to the subclass known as receptor-like kinases (RLKs). The intracellular kinase domains of plant RLKs are all serine/threonine protein kinases, while the extracellular domains of RLKs are of different types. One type of RLK is characterized by the presence of the extracellular S-domain, originally described in self-incompatibility-locus glycoproteins that inhibit self-pollination. The S-domain is recognized by an array of ten cysteine residues in combination with other conserved residues. Another class of RLKs has an extracellular domain distinguished by leucine rich repeats (LRR) that are involved in protein-protein interactions. Binding of ligands to the extracellular domain is followed by receptor dimerization, autophosphorylation and the activation of a series of intracellular proteins which serve to transduce the signal to the nucleus. The structure of plant RLKs is very similar to receptors found in cell signaling pathways in animal systems.

One example of a plant RLK is the Xa21 gene, which confers resistance to the plant pathogen *Xanthomonas oryzae* pv. *oryzae* race 6. This gene was cloned using genetic means comparing *Xanthomonas*-sensitive and resistant strains of rice (Song et al., *Science* 270:1804-1806 (1995)), and has been subsequently been shown to confer resistance to *Xanthomonas* in *Arabidopsis*. The 1025 amino acid protein possesses a number of features with similarity to known protein domains including a $NH_2$-terminal 23 amino acid residue signal peptide, indicating that the protein is directed to the plasma membrane. Amino acids 81 to 634 contain 23 imperfect copies of a 24-amino acid LRR. Amino acids 651 to 676 encode a 26-amino acid hydrophobic segment that is likely to form a membrane-spanning domain. The C-terminal amino acids contain a putative intracellular serine threonine kinase domain carrying 11 subdomains with all 15 invariant amino acids that are typical of protein kinases. Subdomains VI and VIII are indicative of serine-threonine phosphorylation specificity. Xa21 has strong similarities to other RLKs, such as the *Arabidopsis* receptor-like kinase proteins RLK5 and TMK1, showing conservation of both the LRR and protein kinase domains. It is not yet known to what protein Xa21 transduces its pathogen recognition signal.

Another kind of membrane receptor molecule expressed by plant cells is histidine kinases (HKs). HKs have been known for some time in bacterial signal transduction systems, where they form one half of a two-component signaling system. The bacterial HK serves as a sensor molecule for extracellular signals, such as changes in osmoticum, nutrients and toxins. The HK autophosphorylates on a histidine residue in response to ligand binding. This phosphohistidine donates its phosphate group to an aspartate residue of the second member of the two component system, known as the response regulator (RR). The phosphorylated RR then binds DNA in a sequence-specific manner, serving to directly activate specific genes which code for proteins that mediate the response to the extracellular stimulus.

Like bacteria, plant cells have a two-component signaling system which consists of a sensor element HK and a RR. The two components may be separate molecules or may exist as a hybrid molecule (hereinafter referred to as hybrid HK/RR proteins). The HK proteins are distinguished by well-conserved amino acid motifs that occur in a specific order. From the amino terminus, the conserved regions are identified as the H, N, G1, F and G2 boxes. These motifs are usually found within a 200-250 amino acid span of the protein. The G1, F and G2 boxes are thought to be involved in nucleotide binding. As in bacteria, upon receiving the extracellular signal, the HK is autophosphorylated on the histidine residue contained in the H box. The phosphate group is subsequently transferred to the RR. All HKs are believed to phosphorylate a RR, as an obligate part of signal transduction. RRs are characterized by the absolute conservation of an aspartate which is phosphorylated by the phosphohistidine of the HK, and a conserved lysine residue. Unlike bacteria, RRs in plants have not been shown to bind DNA directly. Rather, the plant RRs characterized to date appear to transduce the signal into protein kinase cascades, which eventually phosphorylate and activate or inactivate transcription factors, and thereby affect gene expression.

The ethylene receptor (ETR1; Chang et al. *Science* 262: 539-544) is the best known two-component signaling system in plants. Ethylene is a well known signal molecule that is involved in the regulation of plant development as well as the coordination of fertilization, senescence, skoto/photomorphogenesis and responses to pathogens and mechanical injury. The ethylene receptor is a hybrid HK/RR protein. The signal is transduced through a Raf-like protein kinase named CTR1. CTR1 is a negative regulator of downstream steps in the signaling pathway. While the details of this pathway remain unclear, it appears that the HK is constitutively active in the absence of ethylene, thereby constantly phosphorylating CTR1, which in turn represses other genes in the ethylene response pathway. Binding of ethylene to ETR1 inhibits the HK function of the receptor, resulting in the inhibition of the negative regulator CTR1, thereby allowing the activation of downstream proteins in the ethylene signal transduction cascade. This culminates in activation of ethylene response genes.

More recently, two RR genes, IBC6 and IBC7, which are induced in response to the plant growth regulator cytokinin, have been cloned from *Arabidopsis thaliana* and characterized (Brandstatter and Kieber, *The Plant Cell* 10:1009-1019 (1998)). It is likely that IBC6 and IBC7 are involved in the transduction of the cytokinin signal in plants. This is particularly interesting in light of the fact that a gene encoding the hybrid HK/RR protein CKI1 (Kakimoto, *Science* 274:982-985, 1996) causes cytokinin-like effects when it is ectopically expressed in transgenic plants. Thus it appears likely that a two-component HK/RR system is involved in cytokinin signal transduction. Cytokinin is known to regulate plant growth and development, including such physiological events as nutrient metabolism, expansion and senescence of leaves, and lateral branching.

While polynucleotides encoding proteins involved in plant cell signaling have been isolated for certain species of plants, genes encoding many such proteins have not yet been identified in a wide range of plant species. Thus, there remains a need in the art for materials which may be usefully employed in the modification of cell signaling in plants.

Proper plant growth and development requires the ability to react to environmental and developmental factors. Throughout its life, a plant is subject to changes in light, temperature, water and nutrient availability. Plants are also subject to attack by pathogens, such as viruses, nematodes, mites, and insects. Reacting to developmental and environmental cues requires complex interactions between environmental signals and factors internal to the plant. Such reaction is typically effected by changes in gene expression. Various internal signals are required for coordinating gene expression during development and in response to environmental factors. These internal signals are communicated throughout by signal transduction pathways that allow propagation of the original signal. This ultimately results in the activation or suppression of gene expression.

Plant development is also affected by cell environmental factors such as temperature, nutrient availability, light, etc. See Gastal and Nelon, *Plant Physiol.* 105:191-7 (1994), Ben-Haj-Sahal and Tardieu, *Plant Physiol.* 109:861-7 (1995), and Sacks et al., *Plant Physiol.* 114:519-27 (1997). Plant development and phenotype are affected by cell signaling, and altering expression of the genes involved in the cell signaling can be a useful method of modifying plant development and altering plant phenotype.

The ability to alter expression of cell signaling genes is extremely powerful because cell signaling drives plant development, including growth rates, responses to environmental cues, and resulting plant phenotype. Control of plant cell signaling and phenotypes associated with alteration of cell signaling gene expression has, among others, applications for alteration of wood properties and, in particular, lumber and wood pulp properties. For example, improvements to wood pulp that can be effected by altering cell signaling gene expression include increased or decreased lignin content, increased accessibility of lignin to chemical treatments, improved reactivity of lignin, and increased or decreased cellulose or hemi content. Manipulating the plant signal transduction pathways can also engineer better lumber having increased dimensional stability, increased tensile strength, increased shear strength, increased compression strength, increased shock resistance, increased stiffness, increased or decreased hardness, decreased spirality, decreased shrinkage, and desirable characteristics with respect to weight, density, and specific gravity.

B. Expression Profiling and Microarray Analysis in Plants

The multigenic control of plant phenotype presents difficulties in determining the genes responsible for phenotypic determination. One major obstacle to identifying genes and gene expression differences that contribute to phenotype in plants is the difficulty with which the expression of more than a handful of genes can be studied concurrently. Another difficulty in identifying and understanding gene expression and the interrelationship of the genes that contribute to plant phenotype is the high degree of sensitivity to the environmental factors that plants demonstrate.

There have been recent advances using genome-wide expression profiling. In particular, the use of DNA microarrays has been useful to examine the expression of a large number of genes in a single experiment. Several studies of plant gene responses to developmental and environmental stimuli have been conducted using expression profiling. For example, microarray analysis was employed to study gene expression during fruit ripening in strawberry, Aharoni et al., *Plant Physiol.* 129:1019-1031 (2002), wound response in *Arabidopsis*, Cheong et al., *Plant Physiol.* 129:661-7 (2002), pathogen response in *Arabidopsis*, Schenk et al., *Proc. Nat'l Acad. Sci.* 97:11655-60 (2000), and auxin response in soybean, Thibaud-Nissen et al., *Plant Physiol.* 132:118. Whetten et al., *Plant Mol. Biol.* 47:275-91 (2001) discloses expression profiling of cell wall biosynthetic genes in *Pinus taeda L.* using cDNA probes. Whetten et al. examined genes which were differentially expressed between differentiating juvenile and mature secondary xylem. Additionally, to determine the effect of certain environmental stimuli on gene expression, gene expression in compression wood was compared to normal wood. 156 of the 2300 elements examined showed differential expression. Whetten, supra at 285. Comparison of juvenile wood to mature wood showed 188 elements as differentially expressed. Id. at 286.

Although expression profiling and, in particular, DNA microarrays provide a convenient tool for genome-wide expression analysis, their use has been limited to organisms for which the complete genome sequence or a large cDNA collection is available. See Hertzberg et al., *Proc. Nat'l Acad. Sci.* 98:14732-7 (2001 a), Hertzberg et al., *Plant J.* 25:585 (2001b). For example, Whetten, supra, states, "A more complete analysis of this interesting question awaits the completion of a larger set of both pine and poplar ESTs." Whetten et al. at 286. Furthermore, microarrays comprising cDNA or EST probes may not be able to distinguish genes of the same family because of sequence similarities among the genes. That is, cDNAs or ESTs, when used as microarray probes, may bind to more than one gene of the same family.

Methods of manipulating gene expression to yield a plant with a more desirable phenotype would be facilitated by a better understanding of cell signaling gene expression in various types of plant tissue, at different stages of plant development, and upon stimulation by different environmental cues. The ability to control plant architecture and agronomically important traits would be improved by a better understanding of how cell signaling gene expression effects formation of plant tissues, how cell signaling gene expression protects plants from pathogens and adverse environmental conditions, and how plant growth and the cell signaling are connected. Among the large number of genes, the expression of which can change during development of a plant, only a fraction are likely to effect phenotypic changes of agronomic significance.

SUMMARY

Accordingly, there is a need for tools and methods useful in determining the changes in the expression of cell signaling genes that result in desirable plant phenotypes. There is also a need for polynucleotides useful in such methods. There is a further need for methods which can correlate changes in cell signaling gene expression to a phenotype. There is a further need for methods of identifying cell signaling genes and gene products that impact plant phenotype and that can be manipulated to obtain a desired phenotype.

In one embodiment, an isolated polynucleotide is provided comprising a nucleic acid sequence selected from the group consisting of SEQ ID NO: 1-197 or a conservative variant thereof. In one aspect, the polynucleotide has a sequence comprised in a gene expressed in a wild-type plant of a species of *Eucalyptus* or *Pinus*. In another aspect, the variant has a sequence identity that is greater than or equal to 99%, 98%, 97%, 96%, 95%, 94%, 93%, 92%, 91%, 90%, 89%, 88%, 87%, 86%, 85%, 84%, 83%, 82%, 81%, 80%, 79%, 78%, 77%, 76%, 75%, 74%, 73%, 72%, 71%, 70%, 69%, 68%, 67%, 66%, 65%, 64%, 63%, 62%, 61%, or 60%, to any one of SEQ ID NO: 1-197.

In one aspect, the polynucleotide encodes a protein such as a 14-3-3 protein, 1-aminocyclopropane-1-carboxylate synthase, 1-aminocyclopropane-1-carboxylate oxidase, cyclin-dependant kinase inhibitor, cytokinin oxidase, ethylene receptor, ethylene-responsive elongation factor (EF-TS), F-box family protein, G protein-coupled receptor, GA20-oxidase, giberellic acid insensitive (GAI), gibberellin 2-oxidase, indole-3-acetaldehyde reductase, indole-3-acetonitrilase, Mago Nashi protein, MAP kinase, MAP kinase kinase, MAP kinase kinase kinase, polyphosphoinositide binding protein SSH2P, RAB11G, RAB11J, RAB5B, RAB7, RAN (GTPase activating protein), RAS-like GTP-binding protein, SNF1-related protein kinase, steroid reductase, steroid sulfotransferase, synaptobrevin-like protein or a catalytic domain thereof, or a protein having the same function. In another aspect, the polynucleotide comprises a variant having a sequence identity that is greater than 60%, 65%, 70%, 75%, 80%, 85% or 90% to any one of SEQ ID NO: 1-197 and the protein encoded by the polynucleotide possesses the activity of the protein encoded by the SEQ ID NO: 198-394.

In one embodiment, a plant cell is provided which is transformed with an isolated polynucleotide of SEQ ID NO: 1-197. In another embodiment, a transgenic plant is provided comprising an isolated polynucleotide of SEQ ID NO: 1-197.

In one embodiment, a DNA construct is provided comprising at least one polynucleotide having the sequence of any one of SEQ ID NO: 1-197 or a conservative variants thereof. In one aspect, the DNA construct comprises a promoter operably linked to the polynucleotide. In another aspect, the promoter is selected from any one of a constitutive promoter, a strong promoter, an inducible promoter, a regulatable promoter, a temporally regulated promoter or a tissue-preferred promoter. In another aspect, the DNA construct comprises a polynucleotide encoding an RNA transcript. In yet another aspect, the polynucleotide is positioned along the DNA construct in a sense or antisense orientation relative to the promoter. In one aspect, the RNA transcript induces RNA interference of a polynucleotide having a nucleic acid sequence of any one of SEQ ID NO: 1-197.

In one embodiment, a method of making a transformed plant is provided comprising transforming a plant cell with a DNA construct and culturing the transformed plant cell under conditions that promote growth of a plant.

In another embodiment, a plant cell is provided transformed with a DNA construct. In yet another aspect, a transgenic plant is provided comprising a transformed plant cell. In one aspect, the transformed plant is a woody plant. In another aspect, the woody plant is a tree. In yet another aspect, the plant is of a species of *Eucalyptus* or *Pinus*. In one aspect, the transgenic plants have a phenotype which is different from a phenotype of a plant of the same species that has not been transformed with the DNA construct. In another aspect, the transgenic plant has a different phenotypic characteristic such as lignin quality, lignin structure, wood composition, wood appearance, wood density, wood strength, wood stiffness, cellulose polymerization, fiber dimensions, lumen size, proportion of rays, proportion of vessel elements, other plant components, plant cell division, plant cell development, number of cells per unit area, cell size, cell shape, cell wall composition, proportion of nonlignin cell wall phenolics, rate of wood formation, aesthetic appearance of wood, formation of stem defects, average microfibril angle, width of the S2 cell wall layer, rate of growth, rate of root formation, ratio of root to branch vegetative development, leaf area index, and leaf shape. In yet another aspect, the transgenic plant exhibits one or more traits, such as, increased drought tolerance, herbicide resistance, reduced or increased height, reduced or increased branching, enhanced cold and frost tolerance, improved vigor, enhanced color, enhanced health and nutritional characteristics, improved storage, enhanced yield, enhanced salt tolerance, enhanced resistance of the wood to decay, enhanced resistance to fungal diseases, altered attractiveness to insect pests enhanced heavy metal tolerance, increased disease tolerance, increased insect tolerance, increased water-stress tolerance, enhanced sweetness, improved texture, decreased phosphate content, increased germination, increased micronutrient uptake, improved starch composition, improved flower longevity, production of novel resins, increased or decreased cellulose content, increased or decreased lignin content, increased or decreased nonlignin cell wall phenolics and production of novel proteins or peptides, as compared to a plant of the same species that has not been transformed with the DNA construct. In another aspect, the transgenic plant exhibits one or more traits such as reduced period of juvenility, an increased period of juvenility, propensity to form reaction wood, self-abscising branches, accelerated reproductive development or delayed reproductive development, and accelerated regeneration, as compared to a plant of the same species that has not been transformed with the DNA construct.

In one embodiment, an isolated polynucleotide is provided comprising a nucleic acid sequence encoding the catalytic or substrate-binding domain of a polypeptide selected from of any one of SEQ ID NOs: 198-394 and in which the polynucleotide encodes a polypeptide having the activity of the polypeptide of SEQ ID NOs: 198-394.

In one embodiment, a method of making a transformed plant is provided comprising transforming a plant cell with a DNA construct comprising at least one polynucleotide encoding the catalytic or substrate-binding domain of a polypeptide selected from of any one of SEQ ID NOs: 198-394 and culturing the transformed plant cell under conditions that promote growth of a plant. In one aspect, the method used a DNA construct comprises a promoter operably linked to the polynucleotide. In another aspect, the polypeptide is selected from 14-3-3 protein, 1-aminocyclopropane-1-carboxylate synthase, 1-aminocyclopropane-1-carboxylate oxidase, cyclin-dependant kinase inhibitor, cytokinin oxidase, ethylene receptor, ethylene-responsive elongation factor (EF-TS), F-box family protein, G protein-coupled receptor, GA20-oxidase, giberellic acid insensitive (GAI), gibberellin 2-oxidase, indole-3-acetaldehyde reductase, indole-3-acetonitrilase, Mago Nashi protein, MAP kinase, MAP kinase kinase, MAP kinase kinase kinase, polyphosphoinositide binding protein SSH2P, RAB11G, RAB11J, RAB5B, RAB7, RAN (GTPase activating protein), RAS-like GTP-binding protein, SNF1-related protein kinase, steroid reductase, steroid sulfotransferase, or synaptobrevin-like protein. In one aspect, the method uses a plant cell located within plant explant tissue. In another aspect, the method produces a transgenic plant which exhibits a phenotype different from a plant of the same species that has not been transformed with the DNA construct. In another aspect, the transgenic plant has a different phenotypic characteristic such as lignin quality, lignin structure, wood composition, wood appearance, wood density, wood strength, wood stiffness, cellulose polymerization, fiber dimensions, lumen size, proportion of rays, proportion of vessel elements, other plant components, plant cell division, plant cell development, number of cells per unit area, cell size, cell shape, cell wall composition, proportion of nonlignin cell wall phenolics, rate of wood formation, aesthetic appearance of wood, formation of stem defects, average microfibril angle, width of the S2 cell wall layer, rate of growth, rate of root formation ratio of root to branch vegetative development, leaf area index, and leaf shape. In yet another aspect, the transgenic plant exhibits one or more traits, such as, increased drought tolerance, herbicide resistance, reduced or increased height, reduced or increased branching, enhanced cold and frost tolerance, improved vigor, enhanced color, enhanced health and nutritional characteristics, improved storage, enhanced yield, enhanced salt tolerance, enhanced resistance of the wood to decay, enhanced resistance to fungal diseases, altered attractiveness to insect pests enhanced heavy metal tolerance, increased disease tolerance, increased insect tolerance, increased water-stress tolerance, enhanced sweetness, improved texture, decreased phosphate content, increased germination, increased micronutrient uptake, improved starch composition, improved flower longevity, production of novel resins, increased or decreased cellulose content, increased or decreased lignin content, increased or decreased nonlignin cell wall phenolics and production of novel proteins or peptides, as compared to a plant of the same species that has not been transformed with the DNA construct. In another aspect, the transgenic plant exhibits one or more traits such as reduced period of juvenility, an increased period of juvenility, propensity to form reaction wood, self-abscising branches, accelerated reproductive development or delayed reproductive development, and accelerated regeneration, as compared to a plant of the same species that has not been transformed with the DNA construct.

In one embodiment, wood obtained from a transgenic plant transformed by a DNA construct is provided. In another embodiment, wood pulp obtained from a transgenic plant transformed by a DNA construct is provided.

In another embodiment, a method of making wood is provided comprising transforming a plant with a DNA construct comprising a polynucleotide having a nucleic acid sequence selected from SEQ ID NO: 1-197 and conservative variants thereof, culturing the transformed plants under conditions that promote growth of the plant, and obtaining wood from the plant.

In yet another embodiment, a method of making wood pulp is provided comprising transforming a plant with a DNA construct comprising a polynucleotide having a nucleic acid sequence selected from SEQ ID NO: 1-197 and conservative variants thereof, culturing the transformed plants under conditions that promote growth of the plant, and obtaining wood pulp from the plant.

In one embodiment, an isolated polypeptide is provided comprising an amino acid sequence encoded by a polynucleotide selected from SEQ ID NO: 1-197. In another embodiment, an isolated polynucleotide is provided comprising an amino acid selected from SEQ ID NO: 198-394.

In one embodiment, a method of altering a plant phenotype is provided comprising altering expression in the plant of a polypeptide encoded by any one of SEQ ID NO: 1-197. In one aspect, the expression of the polypeptide can be up-regulated, down-regulated, silenced, or developmentally regulated. In another aspect, the plant phenotype is selected from lignin quality, lignin structure, wood composition, wood appearance, wood density, wood strength, wood stiffness, cellulose polymerization, fiber dimensions, lumen size, proportion of rays, proportion of vessel elements, other plant components, plant cell division, plant cell development, number of cells per unit area, cell size, cell shape, cell wall composition, proportion of nonlignin cell wall phenolics, rate of wood formation, aesthetic appearance of wood, formation of stem defects, average microfibril angle, width of the S2 cell wall layer, rate of growth, rate of root formation ratio of root to branch vegetative development, leaf area index, and leaf shape. In yet another aspect, the plant exhibits one or more traits, such as, increased drought tolerance, herbicide resistance, reduced or increased height, reduced or increased branching, enhanced cold and frost tolerance, improved vigor, enhanced color, enhanced health and nutritional characteristics, improved storage, enhanced yield, enhanced salt tolerance, enhanced resistance of the wood to decay, enhanced resistance to fungal diseases, altered attractiveness to insect pests enhanced heavy metal tolerance, increased disease tolerance, increased insect tolerance, increased water-stress tolerance, enhanced sweetness, improved texture, decreased phosphate content, increased germination, increased micronutrient uptake, improved starch composition, improved flower longevity, production of novel resins, increased or decreased cellulose content, increased or decreased lignin content, increased or decreased nonlignin cell wall phenolics and production of novel proteins or peptides, as compared to a plant of the same species that has not been transformed with the DNA construct. In another aspect, the transgenic plant exhibits one or more traits suach as reduced period of juvenility, an increased period of juvenility, propensity to form reaction wood, self-abscising branches, accelerated reproductive development or delayed reproductive development, and accelerated regeneration, as compared to a plant of the same species that has not been transformed with the DNA construct.

In one embodiment, a polynucleotide is provided comprising a nucleic acid selected from SEQ ID NO: 395-583. In one aspect, the polynucleotide comprises less than about 100 nucleotide bases.

In another embodiment, a method of correlating gene expression in two different samples is provided comprising detecting a level of expression of one or more genes encoding a product encoded by a nucleic acid sequence selected from SEQ ID NOs: 1-197 and conservative variants thereof in a first sample, detecting a level of expression of the one or more genes in a second sample, comparing the level of expression of the one or more genes in the first sample to the level of expression of the one or more genes in the second sample, and correlating a difference in expression level of the one or more genes between the first and second samples. In one aspect, the first sample and the second sample are each from a different type of plant tissue. In another aspect, the first sample and the second sample are from the same tissue, and each sample is harvested during a different season of the year. In yet another aspect, the first sample and the second sample are obtained from plants in different stages of development. In one aspect, the first sample is obtained from a plant not exposed to an environmental stimulus, and the second sample is obtained from a plant exposed to an environmental stimulus. In another aspect, the environmental stimulus is selected from the group consisting of change in temperature, change in amount of light, change in availability of water, change in availability of nutrients, change in availability of atmospheric gases, frost, wounding from mechanical injury, and wounding from attack by an insect, fungus, bacteria or virus.

In one embodiment, a method of correlating the possession of a plant phenotype to the level of gene expression in the plant of one or more genes is provided comprising detecting a level of expression of one or more genes encoding a product encoded by a nucleic acid sequence selected from SEQ ID NOs: 1-197 and conservative variants thereof in a first plant possessing a phenotype, detecting a level of expression of the one or more genes in a second plant lacking the phenotype, comparing the level of expression of the one or more genes in the first plant to the level of expression of the one or more genes in the second plant, and correlating a difference in expression level of the one or more genes between the first and second plants to possession of the phenotype.

In another embodiment, a method of correlating gene expression to a response to an external stimulus or environmental condition is provided comprising detecting a level of expression of one or more genes encoding a product encoded by a nucleic acid sequence selected from the group consisting of SEQ ID NOs: 1-197 and conservative variants thereof in a first plant cell in the absence of the external stimulus or environmental condition, detecting a level of expression of the one or more genes in a second plant cell in the presence of the external stimulus or environmental condition, comparing the level of the expression of the one or more genes in the first plant cells to the level of expression of the one or more genes in the second plants cells; and correlating a difference in expression level of the one or more genes between the first and second samples to presence of the external stimulus or environmental condition. In one aspect, the first and second samples are both obtained from a plant tissue such as vascular tissue, apical meristem, vascular cambium, xylem, phloem, root, flower, cone, fruit, or seed. In another aspect, the plant tissue of the first sample and second samples are each obtained from a different type of tissues. In yet another aspect, the first and second samples are each obtained from a plant tissue in a different stage of development. In one aspect, the external stimulus is selected from the group consisting of change in temperature, change in amount of light, change in availability of water, change in availability of nutrients, wounding from mechanical injury, and wounding from attack by pathogens.

In one embodiment, there are methods provided in which the first and second plants or plant cells are of a species selected from *Eucalyptus* and *Pinus* species. In one aspect, the first and second plants or plant cells are of a species selected from *Eucalyptus grandis* or *Pinus radiata*.

In one embodiment, there are methods provided in which the step of detecting is effected using one or more polynucleotides capable of hybridizing to a nucleic acid sequence selected from the group consisting of SEQ ID NOs: 1-197 under standard hybridization conditions. In one aspect, the step of detecting is effected using one or more polynucleotides capable of hybridizing to a nucleic acid sequence encoded by a nucleic acid sequence selected from the group consisting of SEQ ID NOs: 1-197 under standard hybridization conditions. In another aspect, the step of detecting is effected by hybridization to a labeled nucleic acid. In yet another aspect, the one or more polynucleotides are labeled with a detectable label. In one aspect, at least one of the one or more polynucleotides hybridizes to a 3' untranslated region of one of the one or more genes. In another aspect, at least one of the one or more polynucleotides hybridizes to the 3' untranslated region of one of the one or more genes. In one aspect, the one or more polynucleotides comprise a nucleic acid sequence selected from SEQ ID NOs: 395-583. In another aspect, the one or more polynucleotides comprise a nucleic acid sequence selected from SEQ ID NOs: 395-583. In yet another aspect, the one or more polynucleotides is selected from DNA or RNA. In one aspect, the methods further comprise, prior to the detecting steps, the step of amplifying the one or more genes in the first and second plant or plant cells. In another aspect, the methods further comprise, prior to the detecting steps, the step of labeling the one or more genes in the first and second plant or plant cells with a detectable label.

In one embodiment, a combination for detecting expression of one or more genes is provided comprising two or more oligonucleotides. In one aspect, each oligonucleotide is capable of hybridizing to a nucleic acid sequence selected from SEQ ID NOs: 1-197. In one aspect, each of the two or more oligonucleotides hybridizes to a nucleotide sequence encoded by a different one of the nucleic acid sequences selected from SEQ ID NOs: 1-197. In another aspect, at least one of the two or more oligonucleotides hybridizes to a 3' untranslated region of a nucleic acid sequence selected from SEQ ID NOs: 1-197. In one aspect, each of the two or more oligonucleotides are comprised of fewer than about 100 nucleotide bases. In another aspect, at least one of the two or more oligonucleotides comprises a nucleic acid sequence selected from the group consisting of SEQ ID NOs: 395-583. In one aspect, each of the two or more oligonucleotides hybridizes to a gene encoding a protein selected from a 14-3-3 protein, 1-aminocyclopropane-1-carboxylate synthase, 1-aminocyclopropane-1-carboxylate oxidase, cyclin-dependant kinase inhibitor, cytokinin oxidase, ethylene receptor, ethylene-responsive elongation factor (EF-TS), F-box family protein, G protein-coupled receptor, GA20-oxidase, giberellic acid insensitive (GAI), gibberellin 2-oxidase, indole-3-acetaldehyde reductase, indole-3-acetonitrilase, Mago Nashi protein, MAP kinase, MAP kinase kinase, MAP kinase kinase kinase, polyphosphoinositide binding protein SSH2P, RAB11G, RAB11J, RAB5B, RAB7, RAN (GTPase activating protein), RAS-like GTP-binding protein, SNF1-related protein kinase, steroid reductase, steroid sulfotransferase, and synaptobrevin-like protein. In another aspect, each of the two or more oligonucleotides hybridizes to a gene encoding a different one of the proteins. In one aspect, each of the two or more oligonucleotides hybridizes to a different gene. In yet another aspect, the combination comprises from about 2 to about 5000 of the two or more oligonucleotides. In one embodiment, each of the two or more oligonucleotides is labeled with a detectable label.

In another embodiment, a combination for detecting expression of one or more genes is provided comprising two or more oligonucleotides. In one aspect, each oligonucleotide is capable of hybridizing to a nucleic acid sequence encoded by a nucleic acid sequence selected from SEQ ID NOs: 1-197. In another aspect, each of the two or more oligonucleotides hybridizes to a different one of the nucleic acid sequences selected from SEQ ID NOs: 1-197. In yet another aspect, at least one of the two or more oligonucleotides hybridizes to a 3' untranslated region of a nucleic acid sequence selected from SEQ ID NOs: 1-197. In one aspect, each of the two or more oligonucleotides are comprised of fewer than about 100 nucleotide bases. In another aspect, at least one of the two or more oligonucleotides comprises a nucleic acid sequence selected from the group consisting of SEQ ID NOs 395-583. In another aspect, each of the two or more oligonucleotides hybridizes to a nucleic acid sequence encoded by a gene encoding a protein selected from a 14-3-3 protein, 1-aminocyclopropane-1-carboxylate synthase, 1-aminocyclopropane-1-carboxylate oxidase, cyclin-dependant kinase inhibitor, cytokinin oxidase, ethylene receptor, ethylene-responsive elongation factor (EF-TS), F-box family protein, G protein-coupled receptor, GA20-oxidase, giberellic acid insensitive (GAI), gibberellin 2-oxidase, indole-3-acetaldehyde acetaldehyde reductase, indole-3-acetonitrilase, Mago Nashi protein, MAP kinase, MAP kinase kinase, MAP kinase kinase kinase, polyphosphoinositide binding protein SSH2P, RAB11G, RAB11J, RAB5B, RAB7, RAN (GTPase activating protein), RAS-like GTP-binding protein, SNF1-related protein kinase, steroid reductase, steroid sulfotransferase, and synaptobrevin-like protein. In one aspect, each of the two or more oligonucleotides hybridizes to a nucleic acid sequence encoded by a gene encoding a different one of the proteins. In another aspect, each of the two or more oligonucleotides hybridizes to a nucleic acid sequence encoded by a different gene. In yet another aspect, the combination comprises from about 2 to about 5000 of the two or more oligonucleotides. In one embodiment, each of the two or more oligonucleotides is labeled with a detectable label.

In one embodiment, a microarray is provided comprising a combination described above provided on a solid support, wherein each of said two or more oligonucleotides occupies a unique location on said solid support.

In another embodiment, a method for detecting one or more genes in a sample is provided comprising contacting the sample with two or more oligonucleotides, and detecting the one or more genes of interest which are hybridized to the one or more oligonucleotides. In one aspect, each oligonucleotide is capable of hybridizing to a gene comprising a nucleic acid sequence selected from SEQ ID NOs: 1-197 under standard hybridization conditions. In another aspect, each of the two or more oligonucleotides hybridizes to a gene comprising a different one of the nucleic acid sequences selected from SEQ ID NOs: 1-197. In one aspect, at least one of the two or more oligonucleotides hybridizes to a 3' untranslated region of a gene comprising a nucleic acid sequence selected from SEQ ID NOs: 1-197. In another aspect, each of the two or more oligonucleotides are comprised of fewer than about 100 nucleotide bases. In one aspect, at least one of the two or more oligonucleotides comprises a nucleic acid sequence selected from the group consisting of SEQ ID NOs 395-583. In another aspect, each of the two or more oligonucleotides hybridizes to a gene encoding a protein selected from the group consisting of a 14-3-3 protein, 1-aminocyclopropane-1-carboxylate synthase, 1-aminocyclopropane-1-carboxylate oxidase, cyclin-dependant kinase inhibitor, cytokinin oxidase, ethylene receptor, ethylene-responsive elongation factor (EF-TS), F-box family protein, G protein-coupled receptor, GA20-oxidase, giberellic acid insensitive (GAI), gibberellin 2-oxidase, indole-3-acetaldehyde reductase, indole-3-acetonitrilase, Mago Nashi protein, MAP kinase, MAP kinase kinase, MAP kinase kinase kinase, polyphosphoinositide binding protein SSH2P, RAB11G, RAB11J, RAB5B, RAB7, RAN (GTPase activating protein), RAS-like GTP-binding protein, SNF1-related protein kinase, steroid reductase, steroid sulfotransferase, and synaptobrevin-like protein. In a further aspect, each of the two or more oligonucleotides hybridizes to a gene encoding a different one of the proteins. In another aspect, the two or more oligonucleotides are provided on a solid support, wherein each of the two of more oligonucleotides occupy a unique location on the solid support. In yet another aspect, the solid support comprises from about 2 to about 5000 of the two or more oligonucleotides. In one aspect, the method further comprises prior to the contacting step, the step of amplifying the one or more genes or nucleic acid sequences in the sample. In another aspect, the methods further comprises, prior to the contacting step, the step of labeling the one or more genes or nucleic acid sequences in the sample with a detectable label.

In yet another embodiment, a method for detecting one or more nucleic acid sequences encoded by one or more genes in a sample is provided comprising contacting the sample with two or more oligonucleotides and detecting the one or more nucleic acid sequences which are hybridized to the one or more oligonucleotides. In one aspect, each oligonucleotide is capable of hybridizing to a nucleic acid sequence encoded by a gene comprising a nucleic acid sequence selected from SEQ ID NOs: 1-197 under standard hybridization conditions. In another aspect, each of the two or more oligonucleotides hybridizes to a gene comprising a different one of the nucleic acid sequences selected from SEQ ID NOs: 1-197. In yet another aspect, each of the two or more oligonucleotides hybridizes to a nucleic acid sequence encoded by a gene comprising a different one of the nucleic acid sequences selected from SEQ ID NOs: 1-197. In one aspect, at least one of the two or more oligonucleotides hybridizes to a nucleic acid sequence that is complementary to a 3' untranslated region of a gene comprising a nucleic acid sequence selected from SEQ ID NOs: 1-197. In another aspect, each of the two or more oligonucleotides are comprised of fewer than about 100 nucleotide bases. In one aspect, at least one of the two or more oligonucleotides comprises a nucleic acid sequence selected from the group consisting of SEQ ID NOs 395-583. In another aspect, each of the two or more oligonucleotides hybridizes to a gene encoding a protein selected from the group consisting of a 14-3-3 protein, 1-aminocyclopropane-1-carboxylate synthase, 1-aminocyclopropane-1-carboxylate oxidase, cyclin-dependant kinase inhibitor, cytokinin oxidase, ethylene receptor, ethylene-responsive elongation factor (EF-TS), F-box family protein, G protein-coupled receptor, GA20-oxidase, giberellic acid insensitive (GAI), gibberellin 2-oxidase, indole-3-acetaldehyde reductase, indole-3-acetonitrilase, Mago Nashi protein, MAP kinase, MAP kinase kinase, MAP kinase kinase kinase, polyphosphoinositide binding protein SSH2P, RAB11G, RAB11J, RAB5B, RAB7, RAN (GTPase activating protein), RAS-like GTP-binding protein, SNF1-related protein kinase, steroid reductase, steroid sulfotransferase, and synaptobrevin-like protein. In a further aspect, each of the two or more oligonucleotides hybridizes to a nucleic acid sequence encoded by a gene encoding a different one of the proteins. In another aspect, the two or more oligonucleotides are provided on a solid support, wherein each of the two of more oligonucleotides occupy a unique location on the solid support. In yet another aspect, the solid support comprises from about 2 to about 5000 of the two or more oligonucleotides. In one aspect, the method further comprises prior to the contacting step, the step of amplifying the one or more genes or nucleic acid sequences in the sample. In another aspect, the methods further comprises, prior to the contacting step, the step of labeling the one or more genes or nucleic acid sequences in the sample with a detectable label.

In one embodiment, a kit for detecting gene expression is provided comprising the microarray described above together with one or more buffers or reagents for a nucleotide hybridization reaction.

Other features, objects, and advantages of the present invention are apparent from the detailed description that follows. It should be understood, however, that the detailed description, while indicating preferred embodiments of the invention, are given by way of illustration only, not limitation. Various changes and modifications within the spirit and scope of the invention will be apparent to those skilled in the art from the detailed description.

BRIEF DESCRIPTION OF THE DRAWINGS

FIG. 1 shows the annotated amino acid sequence of SEQ ID NO: 198.
FIG. 2 shows the annotated amino acid sequence of SEQ ID NO: 199.
FIG. 3 shows the annotated amino acid sequence of SEQ ID NO: 200.
FIG. 4 shows the annotated amino acid sequence of SEQ ID NO: 201.
FIG. 5 shows the annotated amino acid sequence of SEQ ID NO: 206.
FIG. 6 shows the annotated amino acid sequence of SEQ ID NO: 207.
FIG. 7 shows the annotated amino acid sequence of SEQ ID NO: 208.
FIG. 8 shows the annotated amino acid sequence of SEQ ID NO: 227.
FIG. 9 shows the annotated amino acid sequence of SEQ ID NO: 283.
FIG. 10 shows the annotated amino acid sequence of SEQ ID NO: 290.
FIG. 11 shows the annotated amino acid sequence of SEQ ID NO: 296.
FIG. 12 shows the annotated amino acid sequence of SEQ ID NO: 307.
FIG. 13 shows the annotated amino acid sequence of SEQ ID NO: 308.
FIG. 14 shows the annotated amino acid sequence of SEQ ID NO: 309.
FIG. 15 shows the annotated amino acid sequence of SEQ ID NO: 320.
FIG. 16 shows the annotated amino acid sequence of SEQ ID NO: 377.
FIG. 17 shows the annotated amino acid sequence of SEQ ID NO: 382.
FIG. 18 shows the annotated amino acid sequence of SEQ ID NO: 388.
FIG. 19 shows the annotated amino acid sequence of SEQ ID NO: 389.
FIG. 20 shows the annotated amino acid sequence of SEQ ID NO: 392.
FIG. 21 shows the annotated amino acid sequence of SEQ ID NO: 230.
FIG. 22 shows the annotated amino acid sequence of SEQ ID NO: 231.
FIG. 23 shows the annotated amino acid sequence of SEQ ID NO: 265.
FIG. 24 shows the annotated amino acid sequence of SEQ ID NO: 269.
FIG. 25 shows the annotated amino acid sequence of SEQ ID NO: 273.
FIG. 26 shows the annotated amino acid sequence of SEQ ID NO: 278.
FIG. 27 shows the annotated amino acid sequence of SEQ ID NO: 316.
FIG. 28 shows the annotated amino acid sequence of SEQ ID NO: 317.
FIG. 29 shows the annotated amino acid sequence of SEQ ID NO: 355.
FIG. 30 shows the annotated amino acid sequence of SEQ ID NO: 372.
FIG. 31 shows the annotated amino acid sequence of SEQ ID NO: 390.
FIG. 32 shows the annotated amino acid sequence of SEQ ID NO: 247.
FIG. 33 shows the annotated amino acid sequence of SEQ ID NO: 346.
FIG. 34 shows the annotated amino acid sequence of SEQ ID NO: 368.
FIG. 35 shows the annotated amino acid sequence of SEQ ID NO: 214.
FIG. 36 shows the annotated amino acid sequence of SEQ ID NO: 274.
FIG. 37 shows the annotated amino acid sequence of SEQ ID NO: 349.
FIG. 38 shows the annotated amino acid sequence of SEQ ID NO: 314.
FIG. 39 shows the annotated amino acid sequence of SEQ ID NO: 213.
FIG. 40 shows the annotated amino acid sequence of SEQ ID NO: 222.
FIG. 41 shows the annotated amino acid sequence of SEQ ID NO: 224.
FIG. 42 shows the annotated amino acid sequence of SEQ ID NO: 228.
FIG. 43 shows the annotated amino acid sequence of SEQ ID NO: 232.
FIG. 44 shows the annotated amino acid sequence of SEQ ID NO: 236.
FIG. 45 shows the annotated amino acid sequence of SEQ ID NO: 237.
FIG. 46 shows the annotated amino acid sequence of SEQ ID NO: 252.
FIG. 47 shows the annotated amino acid sequence of SEQ ID NO: 253.
FIG. 48 shows the annotated amino acid sequence of SEQ ID NO: 256.
FIG. 49 shows the annotated amino acid sequence of SEQ ID NO: 259.
FIG. 50 shows the annotated amino acid sequence of SEQ ID NO: 263.
FIG. 51 shows the annotated amino acid sequence of SEQ ID NO: 268.
FIG. 52 shows the annotated amino acid sequence of SEQ ID NO: 271.
FIG. 53 shows the annotated amino acid sequence of SEQ ID NO: 284.

FIG. 54 shows the annotated amino acid sequence of SEQ ID NO: 286.
FIG. 55 shows the annotated amino acid sequence of SEQ ID NO: 293.
FIG. 56 shows the annotated amino acid sequence of SEQ ID NO: 294.
FIG. 57 shows the annotated amino acid sequence of SEQ ID NO: 305.
FIG. 58 shows the annotated amino acid sequence of SEQ ID NO: 323.
FIG. 59 shows the annotated amino acid sequence of SEQ ID NO: 336.
FIG. 60 shows the annotated amino acid sequence of SEQ ID NO: 343.
FIG. 61 shows the annotated amino acid sequence of SEQ ID NO: 351.
FIG. 62 shows the annotated amino acid sequence of SEQ ID NO: 360.
FIG. 63 shows the annotated amino acid sequence of SEQ ID NO: 363.
FIG. 64 shows the annotated amino acid sequence of SEQ ID NO: 366.
FIG. 65 shows the annotated amino acid sequence of SEQ ID NO: 369.
FIG. 66 shows the annotated amino acid sequence of SEQ ID NO: 373.
FIG. 67 shows the annotated amino acid sequence of SEQ ID NO: 380.
FIG. 68 shows the annotated amino acid sequence of SEQ ID NO: 385.
FIG. 69 shows the annotated amino acid sequence of SEQ ID NO: 394.
FIG. 70 shows the annotated amino acid sequence of SEQ ID NO: 262.
FIG. 71 shows the annotated amino acid sequence of SEQ ID NO: 272.
FIG. 72 shows the annotated amino acid sequence of SEQ ID NO: 347.
FIG. 73 shows the annotated amino acid sequence of SEQ ID NO: 240.
FIG. 74 shows the annotated amino acid sequence of SEQ ID NO: 223.
FIG. 75 shows the annotated amino acid sequence of SEQ ID NO: 313.
FIG. 76 shows the annotated amino acid sequence of SEQ ID NO: 374.
FIG. 77 shows the annotated amino acid sequence of SEQ ID NO: 279.
FIG. 78 shows the annotated amino acid sequence of SEQ ID NO: 288.
FIG. 79 shows the annotated amino acid sequence of SEQ ID NO: 370.
FIG. 80 shows the annotated amino acid sequence of SEQ ID NO: 202.
FIG. 81 shows the annotated amino acid sequence of SEQ ID NO: 203.
FIG. 82 shows the annotated amino acid sequence of SEQ ID NO: 204.
FIG. 83 shows the annotated amino acid sequence of SEQ ID NO: 258.
FIG. 84 shows the annotated amino acid sequence of SEQ ID NO: 311.
FIG. 85 shows the annotated amino acid sequence of SEQ ID NO: 312.
FIG. 86 shows the annotated amino acid sequence of SEQ ID NO: 364.
FIG. 87 shows the annotated amino acid sequence of SEQ ID NO: 212.
FIG. 88 shows the annotated amino acid sequence of SEQ ID NO: 353.
FIG. 89 shows the annotated amino acid sequence of SEQ ID NO: 238.
FIG. 90 shows the annotated amino acid sequence of SEQ ID NO: 325.
FIG. 91 shows the annotated amino acid sequence of SEQ ID NO: 326.
FIG. 92 shows the annotated amino acid sequence of SEQ ID NO: 220.
FIG. 93 shows the annotated amino acid sequence of SEQ ID NO: 221.
FIG. 94 shows the annotated amino acid sequence of SEQ ID NO: 234.
FIG. 95 shows the annotated amino acid sequence of SEQ ID NO: 235.
FIG. 96 shows the annotated amino acid sequence of SEQ ID NO: 248.
FIG. 97 shows the annotated amino acid sequence of SEQ ID NO: 299.
FIG. 98 shows the annotated amino acid sequence of SEQ ID NO: 315.
FIG. 99 shows the annotated amino acid sequence of SEQ ID NO: 324.
FIG. 100 shows the annotated amino acid sequence of SEQ ID NO: 334.
FIG. 101 shows the annotated amino acid sequence of SEQ ID NO: 342.
FIG. 102 shows the annotated amino acid sequence of SEQ ID NO: 344.
FIG. 103 shows the annotated amino acid sequence of SEQ ID NO: 356.
FIG. 104 shows the annotated amino acid sequence of SEQ ID NO: 359.
FIG. 105 shows the annotated amino acid sequence of SEQ ID NO: 367.
FIG. 106 shows the annotated amino acid sequence of SEQ ID NO: 209.
FIG. 107 shows the annotated amino acid sequence of SEQ ID NO: 244.
FIG. 108 shows the annotated amino acid sequence of SEQ ID NO: 261.
FIG. 109 shows the annotated amino acid sequence of SEQ ID NO: 297.
FIG. 110 shows the annotated amino acid sequence of SEQ ID NO: 341.
FIG. 111 shows the annotated amino acid sequence of SEQ ID NO: 358.
FIG. 112 shows the annotated amino acid sequence of SEQ ID NO: 365.
FIG. 113 shows the annotated amino acid sequence of SEQ ID NO: 250.
FIG. 114 shows the annotated amino acid sequence of SEQ ID NO: 280.
FIG. 115 shows the annotated amino acid sequence of SEQ ID NO: 330.
FIG. 116 shows the annotated amino acid sequence of SEQ ID NO: 331.
FIG. 117 shows the annotated amino acid sequence of SEQ ID NO: 357.
FIG. 118 shows the annotated amino acid sequence of SEQ ID NO: 375.
FIG. 119 shows the annotated amino acid sequence of SEQ ID NO: 266.

FIG. 120 shows the annotated amino acid sequence of SEQ ID NO: 327.
FIG. 121 shows the annotated amino acid sequence of SEQ ID NO: 257.
FIG. 122 shows the annotated amino acid sequence of SEQ ID NO: 319.
FIG. 123 shows the annotated amino acid sequence of SEQ ID NO: 329.
FIG. 124 shows the annotated amino acid sequence of SEQ ID NO: 361.
FIG. 125 shows the annotated amino acid sequence of SEQ ID NO: 210.
FIG. 126 shows the annotated amino acid sequence of SEQ ID NO: 211.
FIG. 127 shows the annotated amino acid sequence of SEQ ID NO: 354.
FIG. 128 shows the annotated amino acid sequence of SEQ ID NO: 362.
FIG. 129 shows the annotated amino acid sequence of SEQ ID NO: 300.
FIG. 130 shows the annotated amino acid sequence of SEQ ID NO: 301.
FIG. 131 shows the annotated amino acid sequence of SEQ ID NO: 233.
FIG. 132 shows the annotated amino acid sequence of SEQ ID NO: 264.
FIG. 133 shows the annotated amino acid sequence of SEQ ID NO: 267.
FIG. 134 shows the annotated amino acid sequence of SEQ ID NO: 298.
FIG. 135 shows the annotated amino acid sequence of SEQ ID NO: 376.
FIG. 136 shows the annotated amino acid sequence of SEQ ID NO: 205.
FIG. 137 shows the annotated amino acid sequence of SEQ ID NO: 215.
FIG. 138 shows the annotated amino acid sequence of SEQ ID NO: 241.
FIG. 139 shows the annotated amino acid sequence of SEQ ID NO: 285.
FIG. 140 shows the annotated amino acid sequence of SEQ ID NO: 291.
FIG. 141 shows the annotated amino acid sequence of SEQ ID NO: 292.
FIG. 142 shows the annotated amino acid sequence of SEQ ID NO: 302.
FIG. 143 shows the annotated amino acid sequence of SEQ ID NO: 303.
FIG. 144 shows the annotated amino acid sequence of SEQ ID NO: 304.
FIG. 145 shows the annotated amino acid sequence of SEQ ID NO: 350.
FIG. 146 shows the annotated amino acid sequence of SEQ ID NO: 245.
FIG. 147 shows the annotated amino acid sequence of SEQ ID NO: 260.
FIG. 148 shows the annotated amino acid sequence of SEQ ID NO: 381.
FIG. 149 shows the annotated amino acid sequence of SEQ ID NO: 216.
FIG. 150 shows the annotated amino acid sequence of SEQ ID NO: 217.
FIG. 151 shows the annotated amino acid sequence of SEQ ID NO: 218.
FIG. 152 shows the annotated amino acid sequence of SEQ ID NO: 219.
FIG. 153 shows the annotated amino acid sequence of SEQ ID NO: 226.
FIG. 154 shows the annotated amino acid sequence of SEQ ID NO: 229.
FIG. 155 shows the annotated amino acid sequence of SEQ ID NO: 239.
FIG. 156 shows the annotated amino acid sequence of SEQ ID NO: 255.
FIG. 157 shows the annotated amino acid sequence of SEQ ID NO: 275.
FIG. 158 shows the annotated amino acid sequence of SEQ ID NO: 306.
FIG. 159 shows the annotated amino acid sequence of SEQ ID NO: 318.
FIG. 160 shows the annotated amino acid sequence of SEQ ID NO: 322.
FIG. 161 shows the annotated amino acid sequence of SEQ ID NO: 335.
FIG. 162 shows the annotated amino acid sequence of SEQ ID NO: 348.
FIG. 163 shows the annotated amino acid sequence of SEQ ID NO: 383.
FIG. 164 shows the annotated amino acid sequence of SEQ ID NO: 387.
FIG. 165 shows the annotated amino acid sequence of SEQ ID NO: 393.
FIG. 166 shows the annotated amino acid sequence of SEQ ID NO: 225.
FIG. 167 shows the annotated amino acid sequence of SEQ ID NO: 310.
FIG. 168 shows the annotated amino acid sequence of SEQ ID NO: 242.
FIG. 169 shows the annotated amino acid sequence of SEQ ID NO: 243.
FIG. 170 shows the annotated amino acid sequence of SEQ ID NO: 281.
FIG. 171 shows the annotated amino acid sequence of SEQ ID NO: 287.
FIG. 172 shows the annotated amino acid sequence of SEQ ID NO: 289.
FIG. 173 shows the annotated amino acid sequence of SEQ ID NO: 328.
FIG. 174 shows the annotated amino acid sequence of SEQ ID NO: 332.
FIG. 175 shows the annotated amino acid sequence of SEQ ID NO: 333.
FIG. 176 shows the annotated amino acid sequence of SEQ ID NO: 345.
FIG. 177 shows the annotated amino acid sequence of SEQ ID NO: 378.
FIG. 178 shows the annotated amino acid sequence of SEQ ID NO: 384.
FIG. 179 shows the annotated amino acid sequence of SEQ ID NO: 386.
FIG. 180 shows the annotated amino acid sequence of SEQ ID NO: 270.
FIG. 181 shows the annotated amino acid sequence of SEQ ID NO: 276.
FIG. 182 shows the annotated amino acid sequence of SEQ ID NO: 282.
FIG. 183 shows the annotated amino acid sequence of SEQ ID NO: 339.
FIG. 184 shows the annotated amino acid sequence of SEQ ID NO: 246.
FIG. 185 shows the annotated amino acid sequence of SEQ ID NO: 249.

FIG. 186 shows the annotated amino acid sequence of SEQ ID NO: 251.

FIG. 187 shows the annotated amino acid sequence of SEQ ID NO: 254.

FIG. 188 shows the annotated amino acid sequence of SEQ ID NO: 277.

FIG. 189 shows the annotated amino acid sequence of SEQ ID NO: 295.

FIG. 190 shows the annotated amino acid sequence of SEQ ID NO: 321.

FIG. 191 shows the annotated amino acid sequence of SEQ ID NO: 337.

FIG. 192 shows the annotated amino acid sequence of SEQ ID NO: 338.

FIG. 193 shows the annotated amino acid sequence of SEQ ID NO: 340.

FIG. 194 shows the annotated amino acid sequence of SEQ ID NO: 352.

FIG. 195 shows the annotated amino acid sequence of SEQ ID NO: 379.

FIG. 196 shows the annotated amino acid sequence of SEQ ID NO: 391.

FIG. 197 shows the annotated amino acid sequence of SEQ ID NO: 371.

FIG. 198 shows a graphic representation of the DNA construct pWVR202.

FIG. 199 shows a graphic representation of the DNA construct pGrowth1.

FIG. 200 shows a graphic representation of the DNA construct pGrowth2.

FIG. 201 shows a graphic representation of the DNA construct pGrowth 11.

FIG. 202 shows a graphic representation of the DNA construct pGrowth21.

FIG. 203 shows a graphic representation of the DNA construct pGrowth22.

FIG. 204 shows a graphic representation of the DNA construct pGrowth23.

FIG. 205 shows a graphic representation of the DNA construct pGrowth24.

FIG. 206 shows a graphic representation of the DNA construct pGrowth25.

FIG. 207 shows a graphic representation of the DNA construct pGrowth26.

FIG. 208 shows a graphic representation of the DNA construct pGrowth27.

FIG. 209 shows a graphic representation of the DNA construct pGrowth28.

FIG. 210 shows a graphic representation of the DNA construct pGrowth30.

FIG. 211 shows a graph of the percentage of shoot lines from each line of plants transformed in Example 16.

FIG. 212 shows a graphic representation of the DNA construct pGrowth3.

FIG. 213 shows a graphic representation of the DNA construct pGrowth29.

FIG. 214 shows a graphic representation of the DNA construct pGrowth49.

FIG. 215 shows a graphic representation of the DNA construct pGrowth51.

DETAILED DESCRIPTION

Novel isolated cell signaling genes and polynucleotides useful for identifying the multigenic factors that contribute to a phenotype and for manipulating gene expression to effect a plant phenotype are provided. These genes, which are derived from plants of commercially important forestry genera, pine and *eucalyptus*, are involved in the plant signal transduction and are, at least in part, responsible for expression of phenotypic characteristics important in commercial wood, such as stiffness, strength, density, fiber dimensions, coarseness, cellulose and lignin content, and extractives content. Generally, the genes and polynucleotides encode a protein which can be a 14-3-3 protein, 1-aminocyclopropane-1-carboxylate synthase, 1-aminocyclopropane-1-carboxylate oxidase, cyclin-dependant kinase inhibitor, cytokinin oxidase, ethylene receptor, ethylene-responsive elongation factor (EF-TS), F-box family protein, G protein-coupled receptor, GA20-oxidase, giberellic acid insensitive (GAI), gibberellin 2-oxidase, indole-3-acetaldehyde reductase, indole-3-acetonitrilase, Mago Nashi protein, MAP kinase, MAP kinase kinase, MAP kinase kinase kinase, polyphosphoinositide binding protein SSH2P, RAB11G, RAB11J, RAB5B, RAB7, RAN (GTPase activating protein), RAS-like GTP-binding protein, SNF1-related protein kinase, steroid reductase, steroid sulfotransferase, synaptobrevin-like protein or a catalytic domain thereof, or a polypeptide having the same function, the invention further includes such proteins and polypeptides.

The methods of the present invention for selecting cell signaling gene sequences to target for manipulation permit better design and control of transgenic plants with more highly engineered phenotypes. The ability to control plant architecture and agronomically important traits in commercially important forestry species is improved by the information obtained from the methods, such as which genes affect which phenotypes, which genes affect signal transduction, which genes are active in which stage of plant development, and which genes are expressed in which tissue at a given point in the cell cycle or plant development.

Unless indicated otherwise, all technical and scientific terms are used herein in a manner that conforms to common technical usage. Generally, the nomenclature of this description and the described laboratory procedures, including cell culture, molecular genetics, and nucleic acid chemistry and hybridization, respectively, are well known and commonly employed in the art. Standard techniques are used for recombinant nucleic acid methods, oligonucleotide synthesis, cell culture, tissue culture, transformation, transfection, transduction, analytical chemistry, organic synthetic chemistry, chemical syntheses, chemical analysis, and pharmaceutical formulation and delivery. Generally, enzymatic reactions and purification and/or isolation steps are performed according to the manufacturers' specifications. Absent an indication to the contrary, the techniques and procedures in question are performed according to conventional methodology disclosed, for example, in Sambrook et al., *Molecular Cloning A Laboratory Manual*, 2d ed., Cold Spring Harbor Laboratory Press, Cold Spring Harbor, N.Y. (1989), and F. M. Ausubel et al. (Ed.), *Current Protocols in Molecular Biology*, John Wiley & Sons, New York, N.Y. (2002). Specific scientific methods relevant to the present invention are discussed in more detail below. However, this discussion is provided as an example only, and does not limit the manner in which the methods of the invention can be carried out.

I. Plant Cell Signaling Genes and Gene Products

A. Cell Signaling Genes, Polynucleotide and Polypeptide Sequences

One aspect of the present invention relates to novel cell signaling genes and polypeptides encoded by such genes.

The present invention provides novel plant cell signaling genes and polynucleotides and novel cell signaling proteins and polypeptides. The SEQ ID NOs of exemplary cell signaling genes and their corresponding gene products, i.e. oligonucleotides and proteins, are set forth in TABLE 1. In accordance with one embodiment of the invention, the cell signaling genes are the same as those expressed in a wild-type plant of a species of *Pinus* or *Eucalyptus*. Specific exemplary novel plant cell signaling gene sequences of the invention are set forth in TABLE 2, which comprises *Eucalyptus grandis* and *Pinus radiata* sequences. Corresponding gene products, i.e., proteins and oligonucleotides, are listed in TABLE 3 and TABLE 4.

Cell Signaling genes and gene products affect plant growth and development by a number of disparate mechanisms and biological pathways. Exemplary categories for some of these mechanisms and biological pathways include growth, development and phytohormone response genes, cellular receptor and related genes and intracellular transduction genes are provided. Exemplary genes and gene products for members of these categories are also provided.

1. Growth, Development and Phytohormone Response Genes and Gene Products

Ethylene Response Genes and Gene Products. Ethylene is an important phyotohormone, or plant hormone, because it is involved in virtually all stages of plant growth and development, effecting environmental and developmental responses. Ethylene participates in the regulation of processes such as germination of seeds, senescence, abscission, fruit ripening, responses to environmental stresses such as wounding, flooding, and changes in temperatures or light.

Ethylene is produced from methionine via the formation of S-adenosylmethionine (SAM), which in turn forms the non-protein amino acid, 1-aminocyclopropane-1-carboxylic acid (ACC). ACC is subsequently oxidized to the 2-carbon olefin, ethylene. Two enzymes are unique to the plant ethylene biosynthetic pathway.

One phytormone synthesis gene is 1-aminocyclopropane-1-carboxylate synthase. It is a pyridoxal phosphate dependent enzyme that converts SAM to ACC. Another phytormone synthesis gene is 1-aminocyclopropane-1-carboxylate oxidase. It catalyzes the oxidation of ACC to the 2-carbon olefin, ethylene. Adams and Yang, *Proc. Natl. Acad. Sci. USA* 76:170-174 (1979).

Ethylene production is tightly controlled by regulation of enzyme expression and modulation of enzyme activity dependent upon the availability of cofactors required for catalysis. ACC synthase and ACC oxidase are constitutively present in most plant tissues because small amounts of ethylene are necessary for virtually all stages of development. However, ethylene biosynthesis is increased significantly during fruit ripening. ACC synthase is considered to be the primary, though not exclusive, rate-limiting enzyme in the ethylene biosynthetic pathway, while the regulation of ethylene production via control of ACCO expression and ACCO activity are through to fine-tune the system.

Ethylene signal transduction initiates with ethylene binding at a family of ethylene receptors and terminates in a transcription cascade involving the EIN3/EIL and ERF families of plant-specific transcription factors. Two *Arabidopsis* F box proteins, called EBF1 and EBF2, have been identified that interact physically with EIN3/EIL transcription factors. See Potuschak et al., *Cell*. 115(6):679-89 (2003). EBF1 overexpression results in plants insensitive to ethylene.

During fruit ripening, and through this mechanism, ethylene induces the expression of a number of genes and gene products. Yang & Hoffman, *Annu. Rev. Plant Physiol.* 35:155-189 (1984); Abeles et al., *Ethylene In Plant Biology*, Academic Press, San Diego (1992). For example, the ethylene-responsive elongation factor (EF-TS) is a mitochondrial elongation factor which promotes guanine nucleotide exchange during polypeptide synthesis. See Benichou et al., *Plant Mol. Biol.* 53(3):411-22 (2003).

Gibberellin Response Genes and Gene Products. Another major class of phytohormone is tetracyclic diterpenoids, called Gibberellins (GA). GAs are involved in many processes during plant growth and development, including seed germination, stem elongation, flowering, and fruit development. See Hedden and Kamiya, *Annu. Rev. Plant Physiol. Plant Mol. Biol.* 48:431-60 (1997). Bioactive GAs are perceived at the plasma membrane of the plant cell. See Lovegrove et al., *Plant J.* 15:311-320 (1998). A number of potential components of the GA signaling pathway have been identified using cell biological, pharmacological, and genetic approaches. See Thornton et al., *Trends Plant Sci.* 4:424-428 (1999); Lovegrove and Hooley, *Trends Plant Sci.* 5:102-110 (2000).

It is thought that de novo biosynthesis is the main source of bioactive GA in growing tissues and, as such, the enzymes are likely to be the regulators of GA-related growth. See Huang et al., *Plant Physiol.* 118(3):773-81 (1998). In *Arabidopsis*, there are at least five loci involved in GA biosynthesis: GA1, GA2, GA3, GA4, and GA5. See Koornneef and van der Veen, *Theor. Appl. Genet.* 58:257-263 (1980). For a complete review of the proposed biosynthetic pathway see Finkelstein and Zeevaart, Gibberellins and abscisic acid In *Arabidopsis* (CR Somerville, EM Meyerowitz, eds.), Cold Spring Harbor Laboratory Press, Cold Spring Harbor, N.Y., pp 523-553 (1984). Briefly, the first reaction of the GA biosynthesis pathway is the cyclization of geranylgeranyl pyrophosphate to ent-kaurene, a two-step conversion. Copalyl diphosphate synthase, formerly ent-kaurene synthetase A, the enzyme responsible for the first part of the reaction, is encoded by the GA1 locus and has been cloned. See Sun et al., *Plant Cell* 4:119-128 (1992). The GA2 locus encodes ent-kaurene synthase, which completes the conversion of geranylgeranyl pyrophosphate to ent-kaurene. It is thought that the GA3 locus encodes a Cyt P450 monooxygenase which catalyzes the oxidation of ent-kaurene to ent-kaurenoic acid. It is also thought that GA5 and GA4 encode GA20-oxidase and GA3-hydroxylase, respectively. Both genes have been cloned, and GA5 protein produced in vitro exhibits GA20-oxidase activity. See Chiang et al., *Plant Cell* 7:195-201 (1995); Xu et al., *Proc. Natl. Acad. Sci. U.S.A.* 92:6640-6644 (1995).

GA20-oxidase catalyzes what is thought to be an important aspect of the regulation of the GA biosynthetic pathway—the oxidation of GA at carbon-20. In spinach, enhanced oxidation activity is associated with the bolting response. See Gilmour et al., *Plant Physiol.* 82:190-195 (1986). In maize seedlings, GA20-oxidase activity is down-regulated as a result of feedback control. See Karssen et al. (eds), *Progress in Plant Growth Regulation*, pp 534-544, Kluwer Academic Publishers, Dordrecht, The Netherlands (1992). In *Arabidopsis*, GA20-oxidase is up-regulated when plants are transferred from short-day to long-day conditions. Likewise, it is down-regulated when plants are treated with bioactive GA. Accordingly, it is thought that the developmental and environmental regulation of 20-oxidase gene expression influences plant growth by affecting the level of endogenous gibberellic acid. See Huang et al., *Plant Physiol.* 118(3):773-81 (1998).

As such, catabolism of GAs is an important regulator of the endogenous levels of bioactive gibberellins. In many plant species, bioactive GA are 2-hydroxylated to produce biologically inactive proteins. This step is catalyzed by GA 2-oxidase. This enzyme also inactivates immediate precursors of bioactive GAs. See Ross et al., *Plant J.* 7:513-523 (1995). The expression levels of GA 2-oxidase have been correlated to the presence of bioactive GA. In total, both GA biosynthesis genes and gene products and GA catabolism genes and gene products are regulated through feedback to maintain endogenous levels of bioactive GAs. See Sakamoto et al., *Plant Physiol.* 125(3):1508-16 (2001).

Arabidopsis mutants that are GA-deficient display characteristic phenotypes, including dark green leaves and a dwarf growth habit attributable to reduced stem elongation. See Peng and Harberd, *Plant Physiol.* 113:1051-1058 (1997). A semidominant mutation of *Arabidopsis*, gibberellic acid insensitive (GAI), also confers a dark green, dwarf phenotype. It is thought that the gai mutation affects either GA perception or subsequent signal transduction. Likewise, it is thought that GAI, and its known suppressors, modulate a signal-transduction pathway that represses growth and is opposed by gibberellic acid. See Peng et al., *Genes Dev.* 11(23):3194-205 (1997).

Brassinosteroid Response Genes and Gene Products. Brassinosteroids (BRs) are widely distributed throughout the plant kingdom and elicit unique growth promoting activity when applied exogenously. Mandava, *Annu. Rev. Plant Physiol. Plant Mol. Biol.* 39:23-52 (1988). In many species, BR-deficient mutants show strong dwarfism with dark-green rugose leaves, reduced apical dominance and reduced male fertility. Also, *Arabidopsis* BR-deficient mutants have a prolonged vegetative phase and delayed leaf and chloroplast senescence. See Chory and Li, *Plant Cell Environ.* 20:801-806 (1997).

One *Arabidopsis* BR-deficiency causing mutation, det2, has been cloned and shown to encode a protein analogous to mammalian steroid 5α-reductases. See Li et al., *Science* 272: 398-401 (1996). In mammals, steroid hormones are synthesized from cholesterol via pregnenolone through a series of reactions that modify the ring structure and the side chain of the sterol. Similarly, BRs are thought to be derived from several major phytosterols (e.g., campesterol, sitosterol, and stigmasterol) via multiple oxidation steps. In many mammalian steroid hormones, the reduction of a 4,5 double bond, as catalyzed by 5α-reductase, serves to modulate the biological activity of the steroid hormone. In contrast, known naturally occurring and biologically active BRs lack double bonds in the A and B rings and contain a 5-reduced stereochemistry. Accordingly, it is thought that a steroid 5-reductase must be required for the formation of the trans A/B ring junction that is essential for the biological activity of BRs. See Li et al., *Proc. Natl. Acad. Sci. U.S.A.* 94(8):3554-59 (1997).

Likewise, another *Arabidopsis* BR-deficiency causing mutation, cpd, has been cloned and characterized. See Szekeres et al., *Cell* 85:171-182 (1996). The CPD protein shares sequence homology with several mammalian cytochrome P450 proteins, including several steroid hydroxylases. Mutations in CPD cause phenotypic defects that are similar to those of det2 mutations. Moreover, brassinolide treatment restores a wild-type phenotype to cpd mutants. Accordingly, these and other studies suggest that CPD may encode a steroid 23-hydroxylase.

Much like the control of mammalian steroid biological activity, it is thought that BRs are modulated through a mechanism of hormone inactivation by sulfonation. In this regard, a plant enzyme that catalyzes the O-sulfonation of brassinosteroids and of mammalian estrogenic steroids has been cloned and characterized. See Rouleau et al., *J. Biol. Chem.* 274(30):20925-30 (1999). This steroid sulfotransferase catalyzes a reaction which abolishes BRs biological activity in the bean second internode bioassay. Moreover, the expression of the steroid sulfotransferase genes in some species was found to be induced by salicylic acid, a well-known signal molecule in the plant defense response. This pattern of expression suggests that, in addition to an increased synthesis of proteins having antimicrobial properties, plants respond to pathogen infection by modulating steroid-dependent growth and developmental processes.

Additionally, a large number of *Arabidopsis* BR-insensitive mutants have been characterized and shown to possess a mutation of the same gene. See Li and Chory, *Cell* 90:929-938 (1997). This gene was cloned and shown to possess homology to LRR receptor kinases. As such, it is thought that the BR steroid receptor is a LRR receptor in the plasma membrane.

Cytokinin Response Genes and Gene Products. The phytohormone cytokinin plays a major role in many developmental processes and environmental responses of plants, including leaf senescence, apical dominance, chloroplast development, anthocyanin production, and the regulation of cell division and sink/source relationships. See Hutchison and Kieber, *Plant Cell.* 14:S47-59 (2002). Cytokinins first were identified by their ability to promote cell division in cultured cells in combination with another phytohormone, auxin. See Skoog and Miller, *Symp. Soc. Exp. Biol.* 11:118-131 (1957). It is thought that the influence of cytokinins on morphogenesis is primarily achieved through cell cycle regulation. See Werner et al., *Proc. Natl. Acad. Sci. USA* 98(18): 10487-92 (2001). The hormone is required for S-phase entry in leaf mesophyll protoplasts and tobacco pith explants. See Cooke and Meyer, *Planta* 152:1-7 (1991); Mok and Mok (eds.), *Cytokinins: Chemistry, Activity and Function*, CRC, Boca Raton, Fla. (1994). Additionally, several cell cycle genes are regulated by cytokinins, including, cdc2, CycD3, and others. See, e.g., Hemerly et al., Plant Cell 5:1711-1723 (1993); Riou-Khamlichi et al., Science 283,1541-1544 (1999).

Similar to other phytohormones, the existence of pathways for the degradation and conjugation of cytokinins suggests that the level of these compounds are tightly regulated. For example, Cytokinin oxidase catalyzes the irreversible degradation of in a single enzymatic step by oxidative side chain cleavage. See Schmulling et al., *J. Plant Res.* 116(3):241-52 (2003).

Several of the enzymes encoding the proteins that catalyze these metabolic reactions have been cloned (see, for example, Houba-Hérin et al., *Plant J.* 17:615-626 (1999); Martin et al., *Plant Physiol.* 120:553-557 (1999), Martin et al., *Proc. Natl. Acad. Sci. USA* 96:284-289 (1999); Martin et al., *Proc. Natl. Acad. Sci. USA* 98:5922-5926 (2001); and Morris et al., *Biochem. Biophys. Res. Commun.* 255:328-333 (1999)), as have the genes encoding a key enzyme in cytokinin biosynthesis, isopentyl transferase (see Kakimoto, *Science* 274:982-985 (2001); Takei et al., *J. Biol. Chem.* 276:26405-410 (2001)). Cytokinin biosynthesis and catabolism have been reviewed in depth, for example, in Haberer and Kieber, *Plant Physiol.* 128:354-362 (2001) and Mok and Mok, *Annu. Rev. Plant Physiol. Plant Mol. Biol.* 52:89-118 (2001).

The cytokinin cell signal transduction pathway has also been partially elucidated. See, e.g., Hutchison and Kieber, *Plant Cell* 14:S47-59 (2002). Briefly, cytokinins bind to cytokinin response 1 (CRE1) histidine kinase at the cell membrane, and most likely also to the histidine kinases AHK2 and AHK3. Binding induces autophosphorylation on a Histidine residue within the receptor's transmitter domain. Subsequently, the phosphate is transferred to an Asparagine residue within the fused receiver domain. Then, this phosphate is transferred to a Histidine residue on a phosphotransfer protein (AHP). The AHP translocates to the nucleus, where it activates a response regulator (ARR). The activated ARR then binds to elements within the promoter of other ARRs to increase their rate of transcription. Some ARRs feed back to inhibit their own expression and, possibly, cytokinin signaling in general.

Auxin Response Genes and Gene Products. Further, the first phytohormone discovered, Auxin, also may dramatically affect plant phenotype, growth and development. Auxin has been shown to impact a wide variety of developmental processes, such a stem elongation, apical dominance, root initiation and fruit development. Auxin was first identified as the chemical agent responsible for the phototropism of coleoptile tips. See Thiamann and Skoog, *Vica faba. Proc. R. Soc. Lond. [Biol.]* 114:317-339 (1934). Thiamann and Skoog, among others, discovered that auxin in higher plants is actually indole-3-acetic acid (IAA). It has been recommended that auxins, as a class of hormones, can be defined as any compound that has a biological activity similar to, but not necessarily identical with IAA. See Salisbury (Ed.), *Units, Symbols and Terminology for Plant Physiology*, Oxford University Press, New York, N.Y. (1996). These activities include, for example, the induction of cell elongation in isolated coleoptile or stem sections; the induction of cell division in callus tissues in the presence of a cytokinin; the promotion of lateral root formation at the cut surfaces of stems; the induction of parthenocarpic fruit growth; and the induction of ethylene formation.

Multiple IAA biosynthetic pathways exist in plants, both tryptophan-dependent and tryptophan-independent. In one pathway, called the indole-3-pyruvic acid (IPA) pathway, is thought to be the most common tryptophan-dependent biosynthetic pathway. The IPA pathway involves the deamination of tryptophan to form IPA, followed by a decarboxylation reaction to form indole-3-acetaldehyde (IAid). IAid is then oxidized to form IAA. Alternatively, in the indole-3-acetonitrile (IAN) pathway, tryptophan is converted to indole-3-acetaldoxime and subsequently converted to IAN. A nitrilase then catalyzes the conversion of IAN to IAA.

Likewise, Auxin degradation may occur through may different pathways. In one, it is thought that peroxidase enzymes catalyze the oxidation of IAA to 3-methyleneoxindole. However, the physiological significance of the peroxidase pathway is unclear. See Normanly et al., *Plant Physiol.* 107:323-329 (1995). Two other oxidation pathways have been proposed for the degradation of IAA. In both, the final product is oxindole-3-acetic acid. See Davies (Ed.), *Plant Hormones and Their Role in Plant Growth Development* (2nd ed.), Kluwer, Dordrecht, Netherlands (1995).

Absicisic Acid Response Genes and Gene Products. Absicisic acid (ABA) functions in initiation and maintenance of seed and bud dormancy and response to stress. ABA exerts long-term and short-term control over plant development. Long term effects are mediated by ABA induced gene expression. ABA stimulates synthesis of RAB. ABA also is involved in plant development by interacting, typically as an antagonist, with auxin, cytokinin, and gibberellin. ABA also affects plant tolerance to water stress by preventing desiccation. Proteins which are responsive to ABA, "RAB proteins" are water soluble, rich in glycine and lysine, and low in hydrophobic residues. Rab regulates transport of proteins and RNA across nuclear envelope. Vernoud et al., supra. RAB proteins are discussed in more detail below.

2. Cellular Receptor and Related Genes and Gene Products

Likewise, cell surface receptors communicate outside stimuli and serve as initiation sites for intracellular signaling cascades. For example, a family of cellular receptor genes, including ETR1, ETR2, EIN4, ERS1, and ERS2, has been implicated in ethylene perception in *Arabidopsis thaliana*. See Hua et al., *Cell* 94:261-271 (1998). The ETR1 gene encodes an ethylene receptor, as indicated by the ethylene-binding activity of its amino-terminal domain. See Schaller et al., *Science* 270:1809-1811 (1995). The ETR2 gene products are cellular receptors involved in the development of different plant tissues. See Sakai et al., *Proc. Natl. Acad. Sci. U.S.A.* 95(10):5812-17 (1998).

G-Receptor Coupled Genes and Gene Products. G-receptor coupled receptors (GPCR) constitute another large superfamily of proteins that communicate signals across cell membrane. On the exterior side, they bind to a ligand (which could be a photon, hormone, antigen, growth factor or a neurotransmitter) and at the cytosolic side, they activate a GTP binding protein (G-protein). All GPCRs share one characteristic in that they consist of a single protein chain that crosses the cell membrane seven times. Loops that occur between the cell wall and the cell membrane take part in ligand recognition, while the second and third cytosolic loop and part of the C-terminal end of the receptors are implicated in G-protein recognition.

G proteins are characterized by three subunits: α, β and γ. The α subunit has two domains. Of the two, the function of only one, namely, the ras domain is known in somewhat detail. It contains a GDP/GTP binding site. A covalently attached lipid attaches this subunit to the lipid cell membrane bilayer. After the formation of the ligand-receptor complex, GNRP (guanine nucleotide release protein) catalyzes the removal of GDP and replaces it with GTP. Simultaneously, a subunit is dissociated from the β and γ subunits. Both the GTP-bound subunit and free subunits can activate downstream effectors. Such effectors include adenyl cyclase and ion channels. The cycle returns by the intrinsic GTPase activity of the α-subunit. It hydrolyzes GTP into GDP concomitant with reassociation of the α-subunit with the β and γ subunits.

GPCR is highly expressed in meristemic tissues. See Colucci et al., *Proc. Nat'l Acad. Sci. U.S.A.* 99:4736-41 (2002). GPCR overexpression in *Arabidopsis* results in loss of seed dormancy and shortening of time to flower and fruit set. Overexpression has been shown to lead to excessive cell division in meristem and initiation of additional meristems.

Antisense suppression of GCR1 in *Arabidopsis* results in a phenotype suggestive of a role in cytokinin signaling. See Hooley et al., *Lond. B. Biol. Sci.* 353:1425-30 (1998). Furthermore, transgenic *Arabidopsis* expression antisense GDR1 under the control of constitutive cauliflower mosaic virus 35S promoter show reduced sensitivity to cytokinins in roots and shoots, but respond normally to other plant hormones. This suggests a role for GCR1 in cytokinin signal transduction. Plakidou-Dymock et al., *Curr. Biol.* 12:315-24 (1998).

3. Intracellular Transducer Genes and Gene Products

Cell signaling genes and gene products also can be intracellular transducers along the signaling cascade. One intracellular transducer, the Mago nashi protein, has been studied extensively in *Drosophila*. See Newmark et al., *Development* 124(16):3197-207 (1997). Mago nashi gene products mediate the polarity of the developing *Drosophila* ooctye. A mago nashi gene analog has been found in rice. See Swidzinski et al., *Genome* 44(3):394-400 (2001). Mago nashi gene products were found to be expressed in root, leaf and developing seed tissue as determined by RNA and protein gel blot analysis.

Receptor kinases are also important cell signaling genes. The Ras superfamily of monomeric GTPases comprises Ras, Rab, and Rho/Rac. Ras and Rac relay signals from surface receptors to actin cytoskeleton. Members of Rab are involved in regulating intracellular membrane vesicle traffic. Ras proteins, which are located on inner surface of the membrane, are involved in initiating the kinase cascade that communicates signals from the receptor to the nucleus.

RAB exhibits high degree of functional and structural conservation in all eukaryotic cells studied. Haizel et al., *Plant Physiol.* 108:59-67 (1995). Rab GTPases are a large family of the small GTP-binding protein superfamily. Vernoud, et al., *Plant Physiol.* 131:1191 (2003). Rab has been shown to have a role in intracellular membrane trafficking and to be involved in membrane fusion events. Rab is also thought to be involved in intracellular transport from the ER to Golgi apparatus. Bown and Gatehouse, *Plant Mol. Biol.* 21:1195-99 (1993).

Rab GTPases cycle between inactive GDP-bound form located in cytosol and active GTP-bound form which is membrane associate. Upon binding to target membrane, the RAB GTPase is converted from GDP-bound form the GTP bound form through activation by RABGEF proteins. The intrinsic activity of monomeric GTP-binding proteins is very low. GAPs can modulate the cellular activity of these proteins by several orders of magnitude. Haizel. GAPs bind at specific effector-binding domains.

Most GTP-binding mRNAs are constitutively expressed in similar amounts, RAB1, RAB2, RAB5, RAB7 have elevated levels in root nodules, while certain RAB7, RAB8, and RAB11 are enriched in aerial parts of the plant suggesting that most small GTPases have housekeeping functions whereas a few are required for specialized activities that are important to specialized cells. See Borg et al., *Plant J.* 11:237-50 (1997).

The RAB11 protein is known to also possess regions which participate in GTP binding and hydrolysis. A c-terminal CCXX motif, essential for membrane attachment, is conserved in RAB11. Haizel et al., *Plant Physiol.* 108:59-67 (1995).

RAB5 is associated with early endosomes. See Haizel et al., supra. In vitro assays demonstrated that RAB5 controls early endosome fusion and plays a critical role in trafficking soluble cargoes from prevacuolar compartment to central vacuole during early endocytosis. See Gorvel et al. *Cell* 64:915-25; Sohn et al., *Plant Cell* 15:1057 (2003); Daitoku et al., *Int. J. Mol. Med.* 8:397 (2001).

RAB7 affects the transport of cargo from early endosomes to late endosomes and lysosomes. See Feng et al., *J. Cell Biol.* 131:1435-52 (1995); Mukhopadhyay et al., *J. Biol. Chem.* 272:13055-59 (1997). In plants, RAB7 is localized in late endosomes. Additionally, RAB7 has a conserved effector domain, YKATIGADF. RAB7 has a c-terminal motif that differs from RAB11 (CXC motif). Haizel et al., supra.

Ras-related nuclear protein (RAN) is a 25 kDa nuclear GTP-binding protein with a highly conserved amino acid sequence among plants, animals and fungi. Ach and Gruissem, *Proc. Nat'l Acad. Sci. U.S.A.* 91:5863-7 (1994). Ran complexes with chromatin-associated protein RCC1, a negative regulator of mitosis. Ran is thought to function in a GTPase switch involved in the coupling of the completion of DNA replication to onset of M phase. The role of Ran is thought to be broader, however, than regulation of mitosis only. For example, in tomato, Ran has been shown to be constitutively expressed in all tissues, regardless of the stage of cell cycle. Furthermore, the levels of tomato Ran mRNA do not change during fruit development. In interphase cells, RAN GTPases direct nucleocytoplasmic transport. Like other GTPases, RAN cycles between GDP and GTP bound states. However for RAN, GTP binding and hydrolysis is linked to transport into or out of the nucleus. Unlike other GTPases, RAN is not post-translationally lipid modified and does not associate with cellular membranes. Vernoud et al., supra at 1203.

Ras GTPases are shown to regulate cell proliferation in yeast and mammalian systems. Vernoud, et al., *Plant Physiol.* 131:1191 (2003). This group includes the Rho GTPases. The Rho GTPases are involved in assembly of actin cytoskeleton. Haizel et al., supra. Ras, however, has not yet been identified in plants. Instead, the Ras homologs RAB and RHO have been characterized. Functionally, Ras is activated by the release of GDP. The binding of GTP begins a cascade event. Ras recruits and then binds Raf. The binding of Ras to Raf initiates a phosphorylation cascade called the MAPK cascade. The ethylene receptor ETR1, is thought to pass its signal to CTR1, a protein kinase of the Raf family. In the context of the phosphorylation cascade, Raf is referred to as MAP kinase kinase kinase (MAPKKK). MAPKKK phosphorylates MAPKK which phosphorylates MAPK. MAPK enters the nucleus where it activates other protein kinases, transcription factors, and regulatory proteins.

Three types of receptor-like kinases are known in plants. S receptor kinases have an S domain which consists of 10 cysteins in a particular arrangement with other amino acids. SRK genes are expressed predominantly in pistols. Leucine rich repeat receptors possess a beta-sheet with an exposed face that participates in protein-protein interactions. These proteins are involved in disease resistance by recognition of ligands produced by pathogens and the subsequent activation of intracellular defense response. See Bent et al., *Plant Cell* 8:1757:71 (1996)). S receptor kinases are also involved in the normal development of plants.

At least one class of intracellular transducers, 14-3-3 proteins, function as regulators of a wide range of biological processes. One feature of 14-3-3 proteins is their ability to bind a multitude of functionally diverse signaling proteins, including kinases, phosphatases, and transmembrane receptors. 14-3-3 proteins interact directly with different target proteins. Typically the target protein is phosphorylated, enabling binding of 14-3-3 to the target protein, altering its activity. 14-3-3 binding can is known to directly alter protein activity (either positively or negatively), control nuclear-cytoplasmic shuttling, mediate protein import into mitochondria and chloroplasts, and form a scaffold to permit interactions between two different binding proteins. 14-3-3 proteins are also known to be involved in cell signaling. For example, response to plant pathogens involve 14-3-3 proteins and calmodulin-domain protein kinases (CDPK), MAP kinase pathways, lipoxygenases and ion channels have been identified as potential targets for 14-3-3 proteins important in defense.

The sequences of the invention encode proteins involved in cell signaling. These proteins include 14-3-3 protein, 1-aminocyclopropane-1-carboxylate synthase, 1-aminocyclopropane-1-carboxylate oxidase, cyclin-dependant kinase inhibitor, cytokinin oxidase, ethylene receptor, ethylene-responsive elongation factor (EF-TS), F-box family protein, G protein-coupled receptor, GA20-oxidase, giberellic acid insensitive (GAI), gibberellin 2-oxidase, indole-3-acetaldehyde reductase, indole-3-acetonitrilase, Mago Nashi protein, MAP kinase, MAP kinase kinase, MAP kinase kinase kinase, polyphosphoinositide binding protein SSH2P, RAB11G, RAB11J, RAB5B, RAB7, RAN (GTPase activating protein), RAS-like GTP-binding protein, SNF1-related protein kinase, steroid reductase, steroid sulfotransferase, and synaptobrevin-like protein. As discussed in more detail below, manipulation of the expression of the cell signaling genes and polynucleotides, or manipulation of the activity of the encoded proteins and polypeptides, can result in a transgenic plant with a desired phenotype that differs from the phenotype of a wild-type plant of the same species.

Throughout this description, reference is made to cell signaling gene products. As used herein, a "cell signaling gene product" is a product encoded by a cell signaling gene, and includes both nucleotide products, such as RNA, and amino acid products, such as proteins and polypeptides. Examples of specific cell signaling genes of the invention include SEQ ID NOs: 1-197. Examples of specific cell signaling gene products of the invention include products encoded by any one of SEQ ID NOs: 198-583. Reference also is made herein to cell signaling proteins and cell signaling polypeptides. Examples of specific cell signaling proteins and polypeptides of the invention include polypeptides encoded by any of SEQ ID NOs: 1-197 or polypeptides comprising the amino acid sequence of any of SEQ ID NOs: 198-394.

The present invention also includes sequences that are complements, reverse sequences, or reverse complements to the nucleotide sequences disclosed herein.

The present invention also includes conservative variants of the sequences disclosed herein. The term "variant," as used herein, refers to a nucleotide or amino acid sequence that differs in one or more nucleotide bases or amino acid residues from the reference sequence of which it is a variant.

Thus, in one aspect, the invention includes conservative variant polynucleotides. As used herein, the term "conservative variant polynucleotide" refers to a polynucleotide that hybridizes under stringent conditions to an oligonucleotide probe that, under comparable conditions, binds to the reference gene the conservative variant is a variant of. Thus, for example, a conservative variant of SEQ ID NO: 1 hybridizes under stringent conditions to an oligonucleotide probe that, under comparable conditions, binds to SEQ ID NO: 1. For example, sequences are considered to hybridize when they form a double-stranded complex in a hybridization solution of 6×SSC, 0.5% SDS, 5× Denhardt's solution and 100 µg of non-specific carrier DNA. See F. M. Ausubel et al. (Eds.), *Current Protocols in Molecular Biology*, John Wiley & Sons, New York, N.Y. (2002). "Moderate stringency" is defined as a temperature of 60° C. in a hybridization solution of 6×SSC, 0.5% SDS, 5× Denhardt's solution and 100 µg of non-specific carrier DNA. Id. "High stringency" hybridization conditions are, for example, 68° C. in a hybridization solution of 6×SSC, 0.5% SDS, 5× Denhardt's solution and 100 µg of non-specific carrier DNA. Id. Following the moderate stringency hybridization reaction, the nucleotides are washed in a solution of 2×SSC plus 0.05% SDS for five times at room temperature, with subsequent washes with 0.1×SSC plus 0.1% SDS at 60° C. for 1 h.

One aspect of the invention provides conservative variant polynucleotides that exhibit at least about 75% sequence identity to their respective reference sequences. "Sequence identity" has an art-recognized meaning and can be calculated using published techniques. See *Computational Molecular Biology*, Lesk, ed. (Oxford University Press, 1988), *Biocomputing: Informatics And Genome Projects*, Smith, ed. (Academic Press, 1993), *Computer Analysis Of Sequence Data, Part I*, Griffin & Griffin, eds., (Humana Press, 1994), *Sequence Analysis In Molecular Biology*, Von Heinje ed., Academic Press (1987), *Sequence Analysis Primer*, Gribskov & Devereux, eds. (Macmillan Stockton Press, 1991), Gish et al., *J. Mol. Biol.* 215: 403 (1990); Gish and States, *Nature Genet.* 3: 266 (1993); Madden et al., *Meth. Enzymol.* 266:131 (1996); Altschul et al., *Nucleic Acids Res.* 25: 3389 (1997); and Zhang and Madden, *Genome Res.* 7: 649-656 (1997), and Carillo and Lipton, *SIAM J. Applied Math.* 48: 1073 (1988). Methods commonly employed to determine identity or similarity between two sequences include but are not limited to those disclosed in *Guide To Huge Computers*, Bishop, ed., (Academic Press, 1994) and Carillo & Lipton, supra.

Methods to determine identity and similarity are codified in computer programs. Preferred computer program methods to determine identity and similarity between two sequences include but are not limited to the GCG program package (Devereux et al., *Nucleic Acids Research* 12: 387 (1984)), BLASTP, BLASTN, FASTA (Atschul et al., *J. Mol. Biol.* 215: 403 (1990)), and FASTDB (Brutlag et al., *Comp. App. Biosci.* 6: 237 (1990)).

The invention includes conservative variant polynucleotides having a sequence identity that is greater than or equal to 99%, 98%, 97%, 96%, 95%, 94%, 93%, 92%, 91%, 90%, 89%, 88%, 87%, 86%, 85%, 84%, 83%, 82%, 81%, 80%, 79%, 78%, 77%, 76%, 75%, 74%, 73%, 72%, 71%, 70%, 69%, 68%, 67%, 66%, 65%, 64%, 63%, 62%, 61%, or 60% to any one of 1-29. In such variants, differences between the variant and the reference sequence can occur at the 5' or 3' terminal positions of the reference nucleotide sequence or anywhere between those terminal positions, interspersed either individually among nucleotides in the reference sequence or in one or more contiguous groups within the reference sequence.

Additional conservative variant polynucleotides contemplated by and encompassed within the present invention include polynucleotides comprising sequences that differ from the polynucleotide sequences of SEQ ID NOs: 1-197 or complements, reverse complements or reverse sequences thereof, as a result of deletions and/or insertions totaling less than 30% of the total sequence length. In one embodiment, deletions and/or insertions total less than 20% or less than 10% of the total length.

The invention also includes conservative variant polynucleotides that, in addition to sharing a high degree of similarity in their primary structure (sequence) to SEQ ID NOs have at least one of the following features: (i) they contain an open reading frame or partial open reading frame encoding a polypeptide having substantially the same functional properties in polynucleotide synthesis as the polypeptide encoded by the reference polynucleotide, or (ii) they have nucleotide domains or encoded protein domains in common. The invention includes conservative variants of SEQ ID NOs: 1-197 that encode proteins having the enzyme or biological activity or binding properties of the protein encoded by the reference polynucleotide. Such conservative variants are functional variants, in that they have the enzymatic or binding activity of the protein encoded by the reference polynucleotide.

In accordance with the invention, polynucleotide variants can include a "shuffled gene" such as those described in e.g. U.S. Pat. Nos. 6,500,639, 6,500,617, 6,436,675, 6,379,964, 6,352,859, 6,335,198, 6,326,204 and 6,287,862. A variant of a nucleotide sequence of the present invention also can be a polynucleotide modified as disclosed in U.S. Pat. No. 6,132,970, which is incorporated herein by reference.

In accordance with one embodiment, the invention provides a polynucleotide that encodes a cell signaling protein such as 14-3-3 protein, 1-aminocyclopropane-1-carboxylate synthase, 1-aminocyclopropane-1-carboxylate oxidase, cyclin-dependant kinase inhibitor, cytokinin oxidase, ethylene receptor, ethylene-responsive elongation factor (EF-TS), F-box family protein, G protein-coupled receptor, GA20-oxidase, giberellic acid insensitive (GAI), gibberellin 2-oxidase, indole-3-acetaldehyde reductase, indole-3-acetonitrilase, Mago Nashi protein, MAP kinase, MAP kinase kinase, MAP kinase kinase kinase, polyphosphoinositide binding protein SSH2P, RAB11G, RAB11J, RAB5B, RAB7, RAN (GTPase activating protein), RAS-like GTP-binding protein, SNF1-related protein kinase, steroid reductase, steroid sulfotransferase, and synaptobrevin-like protein. SEQ ID NOs: 1-197 provide examples of such polynucleotides.

In accordance with another embodiment, a polynucleotide of the invention encodes the catalytic or protein binding domain of a polypeptide encoded by any of SEQ ID NOs: 1-197 or of a polypeptide comprising any of SEQ ID NOs: 198-394. The catalytic and protein binding domains of the polysaccharide synthesis proteins of the invention are known in the art. The conserved sequences of these proteins are shown in FIGS. 1-197 as underlined text.

The invention also encompasses as conservative variant polynucleotides that differ from the sequences discussed above but that, as a consequence of the degeneracy of the genetic code, encode a polypeptide which is the same as that encoded by a polynucleotide of the present invention. The invention also includes as conservative variants polynucleotides comprising sequences that differ from the polynucleotide sequences discussed above as a result of substitutions that do not affect the amino acid sequence of the encoded polypeptide sequence, or that result in conservative substitutions in the encoded polypeptide sequence.

The present invention also includes an isolated polypeptide encoded by a polynucleotide comprising any of SEQ ID NOs: 1-197 or any of the conservative variants thereof discussed above. The invention also includes polypeptides comprising SEQ ID NOs: 198-394 and conservative variants of these polypeptides.

In accordance with the invention, a variant polypeptide or protein refers to an amino acid sequence that is altered by the addition, deletion or substitution of one or more amino acids.

The invention includes conservative variant polypeptides. As used herein, the term "conservative variant polypeptide" refers to a polypeptide that has similar structural, chemical or biological properties to the protein it is a conservative variant of. Guidance in determining which amino acid residues can be substituted, inserted, or deleted can be found using computer programs well known in the art such as Vector NTI Suite (InforMax, MD) software. In one embodiment of the invention, conservative variant polypeptides that exhibit at least about 75% sequence identity to their respective reference sequences.

Conservative variant protein includes an "isoform" or "analog" of the polypeptide. Polypeptide isoforms and analogs refers to proteins having the same physical and physiological properties and the same biological function, but whose amino acid sequences differs by one or more amino acids or whose sequence includes a non-natural amino acid.

Polypeptides comprising sequences that differ from the polypeptide sequences of SEQ ID NO: 198-394 as a result of amino acid substitutions, insertions, and/or deletions totaling less than 10% of the total sequence length are contemplated by and encompassed within the present invention.

One aspect of the invention provides conservative variant polypeptides function in cell signaling, as determined by one or more appropriate assays, such as those described below. The invention includes variant polypeptides which are cell signaling or cell signaling-like proteins, such as those participating in the regulation of ethylene synthesis or those genes that encode a peptide having the biological activity of a receptor kinase. As discussed above, the invention includes variant polynucleotides that encode polypeptides that function as cell signaling proteins.

In one embodiment, an isolated polynucleotide comprise a sequence encoding the catalytic or substrate-binding domain from a polypeptide selected from any one of SEQ ID NO: 198-394. In one aspect, the polynucleotide encodes a polypeptide having the same or similar activity of a polypeptide selected from any one of SEQ ID NO: 198-394.

The activities and physical properties of cell signaling proteins can be examined using any method known in the art. The following examples of assay methods are not exhaustive and are included to provide some guidance in examining the activity and distinguishing protein characteristics of cell signaling protein variants. In any case, any and all biological, chemical, enzymatic or radiologic assay method can be used to determine whether a polypeptide has the same or similar activity of another polypeptide.

One such assay monitors DNA synthesis by thymidine incorporation. DNA synthesis correlated, in most cases, with cellular growth. It is monitored in, for example, tissue samples from transformed and control plants by pulse labeling with about 1 µCi of [methyl-$^3$H]thymidine (Ambersham Pharmacia Biotech, Benelux, Roosendaal, The Netherlands) for about 30 minutes at about 28° C. on a rotary shaker. Labeled cells can be collected by centrifugation and immediately frozen in liquid nitrogen. Total DNA and protein can be extracted by grinding and precipitated by standard techniques. Once collected, protein content can be measured using, for example, Bradford reagent (Bio-Rad Laboratories, Hercules, Calif.) or other techniques. Likewise, a protein sample can by hydrolyzed and incorporated radioactivity measured by scintillation counting. Upon quenching correction, total DNA synthesis can be expressed as Bq per µg of protein in the sample. DNA synthesis can also be measured, for example, using the flow cytometrical analysis of nuclei. See, e.g., Porceddu et al., *J. Biol. Chem.* 276(39):36354-360 (2001).

Biological assays using transgenic plants can indicate whether a putative cell signaling gene possesses a specific activity. For example, gibberellin-mutants tend to possess striking phenotypes. See Pend and Harberd, *Plant Physiol.* 113:1051-1058 (1997). Transgenic plants transformed with DNA constructs expressing a putative gibberellic acid insensitive (GAI) gene product, therefore, would be expected exhibit a distinctive GAI phenotype.

Phytohormone concentrations can also be measured. For example, gibberellin and abscisic acid content of transgenic and control plants can be measured using the technique of Green et al., *Plant Physiol.* 114(1):203-212 (1997). Briefly, tissue samples are extracted, purified and analyzed by GC-MS for gibberellins and abscisic acid. GC-MS permits the monitoring of characteristic ions corresponding to biologically gibberellins and biologically inactive gibberellins.

GA20-oxidase activity can be measured in protein extracts by the technique of Xu et al., *Proc. Natl. Acad. Sci. USA* 92(14):6640-6644 (1995). Briefly, extracts are concentrated and used to assay the oxidation of the substrates [$^{14}$C]GA$_{53}$ and [$^{14}$C]GA$_{19}$. The products of the assay are separated using HPLC, collected and again purified by reverse-phase HPLC. The samples are then analyzed by GC-MS.

Likewise, the inactivation of bioactive GA by GA 2-oxidase can be monitored by the technique of Ross et al., *Plant J.* 7:513-523 (1995).

In addition to biological assays using transgenic plants, brassionosteroids response genes and gene products can be measured. For example, a putative steroid sulfotransferase can be assayed using the technique of Rouleau et al., *J. Biol. Chem.* 274(30):20925-30 (1999). Briefly, a purified, recombinant gene product is tested for the ability to transfer the $^{35}$S-labeled sulfonate group from the cosubstrate PAPS (NEN Life Science Products) to brassionosteroids.

Additionally, a functional assay measuring steroid 5α-reductase activity has been described. See Li et al., *Proc. Natl. Acad. Sci. USA* 94:3554-3559 (1997). Briefly, the activity of recombinantly expressed steroid 5α-reductase proteins is measured by the reduction of radiolabeled progesterone to 4,5-dihydroprogesterone. Alternative radiolabeled substrates can be used.

Cytokinins can be measured directly by extraction from plant tissue and purification by HPLC. See Smart et al., *Plant Cell* 3:647-656 (1991). Cytokinin oxidases/dehydrogenases can be measured by the degradation of the cytokinins isopentenyladenine, zeatin, and their ribosides by oxidative side chain cleavage (for a review see Schmulling et al., *J. Plant Res.* 116(3):241-52 (2003). Likewise, activity can be inferred from interation of proteins with the cyclases/histidine kinases associated sensory extracellular domain of the CRE1/WOL/AHK4, AHK2, and AHK3 cellular receptors.

In the case of auxin response gene products, the activity of putative nitrolases can be determined by the technique of Nagasawa et al., *Eur. J. Biochem.* 194:765-772 (1990), using either thiophene-2-acetonitrile or indole-3-acetonitrile as a substrate.

Protein kinase activity can, for example, be measured by quantifying the amount of ATP remaining in solution following a kinase reaction. The kinase gene product is purified using standard techniques and combined with its substrate to form a kinase reaction. A non-radioactive assay is performed in a single well of a 96- or 384-well plate by adding a volume of luciferase reagent (Kinase-Glo™ Reagent, Promega Corporation, Madison Wis.) equal to the volume of solution in the well of a completed kinase reaction. Subsequently, luminescence is measured by a luminomiter. The luminescent signal is correlated with the amount of ATP and inversely correlated with the amount of kinase activity. This assay can be performed with virtually any kinase and substrate combination. The kinase substrate can be a peptide, protein or lipid. Additionally, radiologic methods for detecting kinase reactions are well known.

Likewise, putative SNF1-related protein kinases can, for example, be assayed using the methods of Huang and Huber, *Plant Cell Physiol.* 42(10):1079-87 (2001).

Putative G-coupled proteins can be verified by their ability to bind G-proteins. Briefly, putative G-coupled proteins are expressed as glutathione S-transferase fusion proteins and purified using glutathione-agarose beads. G protein subunits ($G_{i3}$, $G_{i2}$, and $G_o$) from the desired plant species are recombinantly generated and labeled with [$^{35}$S]methionine by in vitro translation. Glutathione S-transferase or recombinant G-coupled proteins proteins are incubated separately with G-proteins which are preincubated with necessary cofactors. The total input of each of the labeled G-protein can be resolved on SDS-PAGE gels stained with Coomassie Brilliant Blue, together with protein samples eluted from the binding assays. Some G-coupled protein activity can also be monitored, for example, through the activation of phospholipase C. See, e.g., Ghosh and Smrcka, *Methods Mol. Biol.* 237:67-75 (2004). Phospholipase C activity can also be measured on microsomal membrane preparations, according to the method described by Zhang et al., *Planta* 215:312-318 (2002)

Small GTP-binding proteins encoded by the Rab and Ran gene families can be monitored using GTP-binding assays or GAP assays. Briefly, GAP assays, filter-binding assays, and the loading small GTP-binding proteins with 5'-[$\gamma^{32}$P]GTP can be done according to the method of Strom et al., *Nature* 361:736-739 (1993). For the analysis of reaction products by TLC, small GTP-binding proteins can be loaded with 5'-[$\alpha^{32}$P]GTP and purified by passage through Bio-Spin 6 chromatography columns (Bio-Rad). A GAP assay mixture can be analyzed by TLC. Aliquots can be spotted onto polyethyleneimine cellulose foils, and the chromatogram developed. The reaction products or the applied GTP and GDP standard can be visualized by autoradiography or by UV light, respectively.

B. Methods of using Cell Signaling Genes, Polynucleotide and Polypeptide Sequences The present invention provides methods of using cell signaling genes and conservative variants thereof. The invention includes methods and constructs for altering expression of cell signaling or cell signaling-like genes and/or gene products for purposes including, but not limited to (i) investigating the gene or gene product role in a cell signaling pathway and its ultimate effect on plant phenotype and (ii) to effect a change in plant phenotype. For example, the invention includes methods and tools for modifying wood quality, fiber development, wood lignin and polysaccharide content, fruit ripening, and plant growth and yield by altering expression of one or more cell signaling genes.

The invention comprises methods of altering the expression of any of the polysaccharide synthesis genes and variants discussed above. Thus, for example, the invention comprises altering expression of a cell signaling gene present in the genome of a wild-type plant of a species of *Eucalyptus* or *Pinus*. In one embodiment, the cell signaling gene comprises a nucleotide sequence selected from SEQ ID NOs: 1-197 sequences or the conservative variants thereof, as discussed above.

1. Techniques to Alter Gene Expression

Techniques which can be employed in accordance with the present invention to alter gene expression, include, but are not limited to: (i) over-expressing a gene product, (ii) disrupting a gene's transcript, such as disrupting a gene's mRNA transcript; (iii) disrupting the function of a polypeptide encoded by a gene, or (iv) disrupting the gene itself. Over-expression of a gene product, the use of antisense RNAs, ribozymes, and the use of double-stranded RNA interference (dsRNAi) are valuable techniques for discovering the functional effects of a gene and for generating plants with a phenotype that is different from a wild-type plant of the same species.

Over-expression of a target gene often is accomplished by cloning the gene or cDNA into an expression vector and introducing the vector into recipient cells. Alternatively, over-expression can be accomplished by introducing exogenous promoters into cells to drive expression of genes residing in the genome. The effect of over-expression of a given gene on cell function, biochemical and/or physiological properties can then be evaluated by comparing plants transformed to over-express the gene to plants that have not been transformed to over-express the gene.

Antisense RNA, ribozyme, and dsRNAi technologies typically target RNA transcripts of genes, usually mRNA. Antisense RNA technology involves expressing in, or introducing into, a cell an RNA molecule (or RNA derivative) that is complementary to, or antisense to, sequences found in a particular mRNA in a cell. By associating with the mRNA, the antisense RNA can inhibit translation of the encoded gene product. The use of antisense technology to reduce or inhibit the expression of specific plant genes has been described, for example in European Patent Publication No. 271988, Smith et al., *Nature,* 334:724-726 (1988); Smith et. al., *Plant Mol. Biol.,* 14:369-379 (1990)).

A ribozyme is an RNA that has both a catalytic domain and a sequence that is complementary to a particular mRNA. The ribozyme functions by associating with the mRNA (through the complementary domain of the ribozyme) and then cleaving (degrading) the message using the catalytic domain.

RNA interference (RNAi) involves a post-transcriptional gene silencing (PTGS) regulatory process, in which the steady-state level of a specific mRNA is reduced by sequence-specific degradation of the transcribed, usually fully processed mRNA without an alteration in the rate of de novo transcription of the target gene itself. The RNAi technique is discussed, for example, in Elibashir, et al., *Methods Enzymol.* 26:199 (2002); McManus & Sharp, *Nature Rev. Genetics* 3:737 (2002); PCT application WO 01/75164; Martinez et al., *Cell* 110:563 (2002); Elbashir et al., supra; Lagos-Quintana et al., *Curr. Biol.* 12:735 (2002); Tuschl et al., *Nature Biotechnol.* 20:446 (2002); Tuschl, *Chembiochem.* 2:239 (2001); Harborth et al., *J. Cell Sci.* 114:4557 (2001); et al., *EMBO J.* 20:6877 (2001); Lagos-Quintana et al., *Science* 294:8538 (2001); Hutvagner et al., loc cit, 834; Elbashir et al., *Nature* 411:494 (2001).

2. DNA Constructs

The present invention provides a DNA construct comprising at least one polynucleotide of SEQ ID NOs: 1-197 or conservative variants thereof, such as the conservative variants discussed above. Any method known in the art can be used to generate the DNA constructs of the present invention. See, e.g., Sambrook et al., supra.

The invention includes DNA constructs that optionally comprise a promoter. Any suitable promoter known in the art can be used. A promoter is a nucleic acid, preferably DNA, that binds RNA polymerase and/or other transcription regulatory elements. As with any promoter, the promoters of the invention facilitate or control the transcription of DNA or RNA to generate an mRNA molecule from a nucleic acid molecule that is operably linked to the promoter. The RNA can encode a protein or polypeptide or can encode an antisense RNA molecule or a molecule useful in RNAi. Promoters useful in the invention include constitutive promoters, inducible promoters, temporally regulated promoters and tissue-preferred promoters.

Examples of useful constitutive plant promoters include: the cauliflower mosaic virus (CaMV) 35S promoter, which confers constitutive, high-level expression in most plant tissues (Odel et al., *Nature* 313:810(1985)); the nopaline synthase promoter (An et al., *Plant Physiol.* 88:547 (1988)); and the octopine synthase promoter (Fromm et al., *Plant Cell* 1:977 (1989)). It should be noted that, although the CaMV 35S promoter is commonly referred to as a constitutive promoter, some tissue preference can be seen. The use of CaMV 35S is envisioned by the present invention, regardless of any tissue preference which may be exhibited during use in the present invention.

Inducible promoters regulate gene expression in response to environmental, hormonal, or chemical signals. Examples of hormone inducible promoters include auxin-inducible promoters (Baumann et al., *Plant Cell* 11:323-334(1999)), cytokinin-inducible promoters (Guevara-Garcia, *Plant Mol. Biol.* 38:743-753(1998)), and gibberellin-responsive promoters (Shi et al. *Plant Mol. Biol.* 38:1053-1060(1998)). Additionally, promoters responsive to heat, light, wounding, pathogen resistance, and chemicals such as methyl jasmonate or salicylic acid, can be used in the DNA constructs and methods of the present invention.

Tissue-preferred promoters allow for preferred expression of polynucleotides of the invention in certain plant tissue. Tissue-preferred promoters are also useful for directing the expression of antisense RNA or iRNA in certain plant tissues, which can be useful for inhibiting or completely blocking the expression of targeted genes as discussed above. As used herein, vascular plant tissue refers to xylem, phloem or vascular cambium tissue. Other preferred tissue includes apical meristem, root, seed, and flower. In one aspect, the tissue-preferred promoters of the invention are either "xylem-preferred," "cambium-preferred" or "phloem-preferred," and preferentially direct expression of an operably linked nucleic acid sequence in the xylem, cambium or phloem, respectively. In another aspect, the DNA constructs of the invention comprise promoters that are tissue-specific for xylem, cambium or phloem, wherein the promoters are only active in the xylem, cambium or phloem.

A vascular-preferred promoter is preferentially active in any of the xylem, phloem or cambium tissues, or in at least two of the three tissue types. A vascular-specific promoter is specifically active in any of the xylem, phloem or cambium, or in at least two of the three. In other words, the promoters are only active in the xylem, cambium or phloem tissue of plants. Note, however, that because of solute transport in plants, a product that is specifically or preferentially expressed in a tissue may be found elsewhere in the plant after expression has occurred.

Additionally, the promoters of particular cell signaling genes may be expressed only within the cambium in developing secondary vasculature. Within the cambium, particular polysaccharide synthesis gene promoters may be expressed exclusively in the stem or in the root. Moreover, the cell signaling promoters may be expressed only in the spring or only in the summer, fall or winter.

A promoter may be operably linked to the polynucleotide. As used in this context, operably linked refers to linking a polynucleotide encoding a structural gene to a promoter such that the promoter controls transcription of the structural gene. If the desired polynucleotide comprises a sequence encoding a protein product, the coding region can be operably linked to regulatory elements, such as to a promoter and a terminator, that bring about expression of an associated messenger RNA transcript and/or a protein product encoded by the desired polynucleotide. In this instance, the polynucleotide is operably linked in the 5'- to 3'-orientation to a promoter and, optionally, a terminator sequence.

Alternatively, the invention provides DNA constructs comprising a polynucleotide in an "antisense" orientation, the transcription of which produces nucleic acids that can form secondary structures that affect expression of an endogenous cell signaling gene in the plant cell. In another variation, the DNA construct may comprise a polynucleotide that yields a double-stranded RNA product upon transcription that initiates RNA interference of a cell signaling gene with which the polynucleotide is associated. A polynucleotide of the present invention can be positioned within a t-DNA, such that the left and right t-DNA border sequences flank or are on either side of the polynucleotide.

It should be understood that the invention includes DNA constructs comprising one or more of any of the polynucleotides discussed above. Thus, for example, a construct may comprise a t-DNA comprising one, two, three, four, five, six, seven, eight, nine, ten, or more polynucleotides.

The invention also includes DNA constructs comprising a promoter that includes one or more regulatory elements. Alternatively, the invention includes DNA constructs comprising a regulatory element that is separate from a promoter. Regulatory elements confer a number of important characteristics upon a promoter region. Some elements bind transcription factors that enhance the rate of transcription of the operably linked nucleic acid. Other elements bind repressors that inhibit transcription activity. The effect of transcription factors on promoter activity can determine whether the promoter activity is high or low, i.e. whether the promoter is "strong" or "weak."

A DNA construct of the invention can include a nucleotide sequence that serves as a selectable marker useful in identifying and selecting transformed plant cells or plants. Examples of such markers include, but are not limited to, a neomycin phosphotransferase (nptII) gene (Potrykus et al., *Mol. Gen. Genet.* 199:183-188 (1985)), which confers kanamycin resistance. Cells expressing the nptII gene can be selected using an appropriate antibiotic such as kanamycin or G418. Other commonly used selectable markers include a mutant EPSP synthase gene (Hinchee et al., *BioTechnology* 6:915-922 (1988)), which confers glyphosate resistance; and a mutant acetolactate synthase gene (ALS), which confers imidazolinone or sulphonylurea resistance (European Patent Application No. 154,204).

The present invention also includes vectors comprising the DNA constructs discussed above. The vectors can include an origin of replication (replicons) for a particular host cell. Various prokaryotic replicons are known to those skilled in the art, and function to direct autonomous replication and maintenance of a recombinant molecule in a prokaryotic host cell.

For example, pMON530 is an *Agrobacterium*-based plant transformation vector for use in transformation of dicotyledonous plants is plasmid vector (Rogers et al., Improved vectors for plant transformation: expression cassette vectors and new selectable markers, in *Recombinant DNA Methodology*, Wu et al. (Ed.), Academic Press, San Diego, Calif. (1989). Another useful plasmid is pMON530, a derivative of pMON505, prepared by transferring the 2.3 kb StuI-HindIII fragment of pMON316 into pMON526. Plasmid pMON526 is a simple derivative of pMON505 in which the SmaI site is removed by digestion with XmaI, treatment with Klenow polymerase and ligation. Plasmid pMON530 retains all the properties of pMON505 and the CaMV35S-NOS expression cassette, but contains a unique cleavage site for SmaI between the promoter and polyadenylation signal.

Binary vector pMON505 is a derivative of pMON200 (Rogers et al., supra) in which the Ti plasmid homology region, LIH, is replaced with a 3.8 kb HindIII to SmaI segment of the mini RK2 plasmid, pTJS75 (Schmidhauser and Helinski, *J. Bacteriol.* 164(1):446-55 (1985)). This segment contains the RK2 origin of replication, oriV, and the origin of transfer, oriT, for conjugation into *Agrobacterium* using the tri-parental mating procedure. Horsch and Klee., *Proc. Natl. Acad. Sci. U.S.A.* 83:4428 (1986). Plasmid pMON505 retains all the important features of pMON200 including the synthetic multi-linker for insertion of desired DNA fragments, the chimeric NOS/NPTII'/NOS gene for kanamycin resistance in plant cells, the *spectinomycin/streptomycin* resistance determinant for selection in *E. coli* and *A. tumefaciens*, an intact nopaline synthase gene for facile scoring of transformants and inheritance in progeny, and a pBR322 origin of replication for ease in making large amounts of the vector in *E. coli*. Plasmid pMON505 contains a single T-DNA border derived from the right end of the pTiT37 nopaline-type T-DNA. Southern blot analyses demonstrate that plasmid pMON505 and any DNA that it carries are integrated into the plant genome, that is, the entire plasmid is the T-DNA that is inserted into the plant genome. One end of the integrated DNA is located between the right border sequence and the nopaline synthase gene and the other end is between the border sequence and the pBR322 sequences.

A particularly useful Ti plasmid cassette vector is pMON17227. This vector is described in WO 92/04449 and contains a gene encoding an enzyme conferring glyphosate resistance (denominated CP4), which is an excellent selection marker gene for many plants, including potato and tomato. The gene is fused to the *Arabidopsis* EPSPS chloroplast transit peptide (CTP2), and expression is driven by the promoter of choice.

In one embodiment, the DNA constructs comprise the polynucleotides pWVR8 or pART27 as described in Gleave, *Plant Mol. Biol.* 20:1203-27 (1992), or a fragment thereof. In another embodiment, the DNA constructs comprise any suitably modified Ti plasmid or a fragment thereof.

In one embodiment, the DNA constructs comprise at least one polynucleotide having any one of the sequences of SEQ ID NO: 1-197 and conservative variants thereof. In a further embodiment, the DNA constructs comprise a promoter such that the promoter is operably linked to the one or more polynuceotides. In another aspect, the promoter can be a constitutive promoter, a strong promoter, an inducible promoter, a regulatable promoter, a temporally regulated promoter, or a tissue-preferred promoter.

3. Transformed Host Cells, Plant Tissue and Plants

The invention also provides host cells which are transformed with the DNA constructs of the invention. As used herein, a host cell refers to the cell in which a polynucleotide of the invention is expressed. Accordingly, a host cell can be an individual cell, a cell culture or cells that are part of an organism. The host cell can also be a portion of an embryo, endosperm, sperm or egg cell, or a fertilized egg. In one aspect, the host cell is a plant cell. In another aspect, the plant cell is transformed with at least one polynucleotide selected from SEQ ID NO: 1-197.

The present invention further provides transgenic plants comprising the DNA constructs of the invention. The invention includes transgenic plants that are angiosperms or gymnosperms. The DNA constructs of the present invention can be used to transform a variety of plants, both monocotyledonous (e.g. grasses, corn, grains, oat, wheat and barley), dicotyledonous (e.g., *Arabidopsis*, tobacco, legumes, alfalfa, oaks, *eucalyptus*, maple), and Gymnosperms (e.g., Scots pine disclosed in Aronen et al., *Tree Physiol.* 15(1):65-70 (1995), white spruce disclosed in Ellis et al., *Plant Mol. Biol.* 17(1): 19-27(1991)), and larch (Huang et al., *In Vitro Cell* 27:201-207 (1991)).

The plants also include turfgrass, wheat, maize, rice, sugar beet, potato, tomato, lettuce, carrot, strawberry, cassava, sweet potato, geranium, soybean, and various types of woody plants. Woody plants include trees such as palm oak, pine, maple, fir, apple, fig, plum and acacia. Woody plants also include rose and grape vines.

In one embodiment, a transgenic plant is provided comprising at least one polynucleotide selected from SEQ ID NO: 1-197.

In one embodiment, the DNA constructs of the invention are used to transform woody plants, i.e., trees or shrubs whose stems live for a number of years and increase in diameter each year by the addition of woody tissue. The invention includes methods of transforming plants including *eucalyptus* and pine species of significance in the commercial forestry industry such as plants selected from the group consisting of *Eucalyptus grandis* and its hybrids, and *Pinus taeda*, as well as the transformed plants and wood and wood pulp derived therefrom. Other examples of suitable plants include those selected from the group consisting of *Pinus banksiana, Pinus brutia, Pinus caribaea, Pinus clausa, Pinus contorta, Pinus coulteri, Pinus echinata, Pinus eldarica, Pinus ellioti, Pinus jeffreyi, Pinus lambertiana, Pinus massoniana, Pinus monticola, Pinus nigra, Pinus palustris, Pinus pinaster, Pinus pon-

*derosa, Pinus radiata, Pinus resinosa, Pinus rigida, Pinus serotina, Pinus strobis, Pinus sylvestris, Pinus taeda, Pinus virginiana, Abies amabilis, Abies balsamea, Abies concolor, Abies grandis, Abies lasiocarpa, Abies magnifica, Abies procera, Chamaecyparis lawsoniona, Chamaecyparis nootkatensis, Chamaecyparis thyoides, Juniperus virginiana, Larix decidua, Larix laricina, Larix leptolepis, Larix occidentalis, Larix siberica, Libocedrus decurrens, Picea abies, Picea engelmanni, Picea glauca, Picea mariana, Picea pungens, Picea rubens, Picea sitchensis, Pseudotsuga menziesii, Sequoia gigantea, Sequoia sempervirens, Taxodium distichum, Tsuga canadensis, Tsuga heterophylla, Tsuga mertensiana, Thuja occidentalis, Thuja plicata, Eucalyptus alba, Eucalyptus bancroftii, Eucalyptus botryoides, Eucalyptus bridgesiana, Eucalyptus calophylla, Eucalyptus camaldulensis, Eucalyptus citriodora, Eucalyptus cladocalyx, Eucalyptus coccifera, Eucalyptus curtisii, Eucalyptus dalrympleana, Eucalyptus deglupta, Eucalyptus delagatensis, Eucalyptus diversicolor, Eucalyptus dunnii, Eucalyptus ficifolia, Eucalyptus globulus, Eucalyptus gomphocephala, Eucalyptus gunnii, Eucalyptus henryi, Eucalyptus laevopinea, Eucalyptus macarthurii, Eucalyptus macrorhyncha, Eucalyptus maculata, Eucalyptus marginata, Eucalyptus megacarpa, Eucalyptus melliodora, Eucalyptus nicholii, Eucalyptus nitens, Eucalyptus nova-angelica, Eucalyptus obliqua, Eucalyptus occidentalis, Eucalyptus obtusiflora, Eucalyptus oreades, Eucalyptus pauciflora, Eucalyptus polybractea, Eucalyptus regnans, Eucalyptus resinifera, Eucalyptus robusta, Eucalyptus rudis, Eucalyptus saligna, Eucalyptus sideroxylon, Eucalyptus stuartiana, Eucalyptus tereticomis, Eucalyptus torelliana, Eucalyptus umigera, Eucalyptus urophylla, Eucalyptus viminalis, Eucalyptus viridis, Eucalyptus wandoo,* and *Eucalyptus youmanni.*

As used herein, the term "plant" also is intended to include the fruit, seeds, flower, strobilus, etc. of the plant. A transformed plant of the current invention can be a direct transfectant, meaning that the DNA construct was introduced directly into the plant, such as through *Agrobacterium*, or the plant can be the progeny of a transfected plant. The second or subsequent generation plant can be produced by sexual reproduction, i.e., fertilization. Furthermore, the plant can be a gametophyte (haploid stage) or a sporophyte (diploid stage).

As used herein, the term "plant tissue" encompasses any portion of a plant, including plant cells. Plant cells include suspension cultures, callus, embryos, meristematic regions, callus tissue, vascular tissue, apical meristem, vascular cambium, xylem, phloem, flower, leaves, roots, shoots, gametophytes, sporophytes, pollen, seeds and microspores. Plant tissues can be grown in liquid or solid culture, or in soil or suitable media in pots, greenhouses or fields. As used herein, "plant tissue" also refers to a clone of a plant, seed, progeny, or propagule, whether generated sexually or asexually, and descendents of any of these, such as cuttings, cone, fruit, and seeds.

In accordance with one aspect of the invention, a transgenic plant that has been transformed with a DNA construct of the invention has a phenotype that is different from a plant that has not been transformed with the DNA construct.

As used herein, "phenotype" refers to a distinguishing feature or characteristic of a plant which can be altered according to the present invention by integrating one or more DNA constructs of the invention into the genome of at least one plant cell of a plant. The DNA construct can confer a change in the phenotype of a transformed plant by modifying any one or more of a number of genetic, molecular, biochemical, physiological, morphological, or agronomic characteristics or properties of the transformed plant cell or plant as a whole.

For example, gibberellic acid insensitive plants have characteristic phenotypes typified by dark green leaves and reduced stem elongation resulting in a dwarf growth habit. See Peng and Harberd, *Plant Physiol.* 113:1051-1058 (1997). Thus, plant stem cell growth can be modulated by altering the GA cell signaling cascade, its biosynthesis or degradation. Gene and gene products which catalyze each of these events can be used to increase or decrease plant stem cell growth. In this manner, the polynucleotides of the invention can be used to modulate GA cell signaling cascade, its biosynthesis or degradation, and thereby mediate plant growth.

In one embodiment, transformation of a plant with a DNA construct of the present invention can yield a phenotype including, but not limited to any one or more of increased drought tolerance, herbicide resistance, reduced or increased height, reduced or increased branching, enhanced cold and frost tolerance, improved vigor, enhanced color, enhanced health and nutritional characteristics, improved storage, enhanced yield, enhanced salt tolerance, enhanced resistance of the wood to decay, enhanced resistance to fungal diseases, altered attractiveness to insect pests enhanced heavy metal tolerance, increased disease tolerance, increased insect tolerance, increased water-stress tolerance, enhanced sweetness, improved texture, decreased phosphate content, increased germination, increased micronutrient uptake, improved starch composition, improved flower longevity, production of novel resins, increased or decreased cellulose content, increased or decreased lignin content, increased or decreased nonlignin cell wall phenolics and production of novel proteins or peptides.

In another embodiment, the affected phenotype includes one or more of the following traits: propensity to form reaction wood, a reduced period of juvenility, an increased period of juvenility, self-abscising branches, accelerated reproductive development or delayed reproductive development, as compared to a plant of the same species that has not been transformed with the DNA construct.

In a further embodiment, the phenotype that is different in the transgenic plant includes one or more of the following: lignin quality, lignin structure, wood composition, wood appearance, wood density, wood strength, wood stiffness, cellulose polymerization, fiber dimensions, lumen size, proportion of rays, proportion of vessel elements, other plant components, plant cell division, plant cell development, number of cells per unit area, cell size, cell shape, cell wall composition, rate of wood formation, aesthetic appearance of wood, formation of stem defects, average microfibril angle, width of the S2 cell wall layer, rate of growth, rate of root formation ratio of root to branch vegetative development, leaf area index, and leaf shape.

Phenotype can be assessed by any suitable means. The plants can be evaluated based on their general morphology. Transgenic plants can be observed with the naked eye, can be weighed and their height measured. The plant can be examined by isolating individual layers of plant tissue, namely phloem and cambium, which is further sectioned into meristematic cells, early expansion, late expansion, secondary wall formation, and late cell maturation. See, e.g., Hertzberg, supra. The plants also can be assessed using microscopic analysis or chemical analysis.

Microscopic analysis includes examining cell types, stage of development, and stain uptake by tissues and cells. Fiber morphology, such as fiber wall thickness and microfibril angle of wood pulp fibers can be observed using, for example, microscopic transmission ellipsometry. See Ye and Sundström, *Tappi J.* 80:181 (1997). Wood strength, density, and grain slope in wet wood and standing trees can be determined by measuring the visible and near infrared spectral data in conjunction with multivariate analysis. See U.S. Patent Application Publication Nos. 2002/0107644 and 2002/0113212. Lumen size can be measured using scanning electron microscopy. Lignin structure and chemical properties can be observed using nuclear magnetic resonance spectroscopy as described in Marita et al., *J. Chem. Soc., Perkin Trans. I* 2939 (2001).

The biochemical characteristic of lignin, cellulose, carbohydrates and other plant extracts can be evaluated by any standard analytical method known including spectrophotometry, fluorescence spectroscopy, HPLC, mass spectroscopy, and tissue staining methods.

In one embodiment, the making of a transformed plant comprises transforming a plant cell with a DNA construct and culturing the transformed plant cell under conditions that promote growth of a plant.

As used herein, "transformation" refers to a process by which a nucleic acid is inserted into the genome of a plant cell. Such insertion encompasses stable introduction into the plant cell and transmission to progeny. Transformation also refers to transient insertion of a nucleic acid, wherein the resulting transformant transiently expresses the nucleic acid. Transformation can occur under natural or artificial conditions using various methods well known in the art. See, e.g., Glick and Thompson (Eds.), *Methods In Plant Molecular Biology*, CRC Press, Boca Raton, Fla. (1993). Transformation can be achieved by any known method for the insertion of nucleic acid sequences into a prokaryotic or eukaryotic host cell, including *Agrobacterium*-mediated transformation protocols (see, e.g., Horsch et al., *Science* 227:1229-31 (1985), viral infection, whiskers, electroporation (see, e.g., Rhodes et al., *Science* 240(4849):204-207 (1988), microinjection, polyethylene glycol-treatment (see, e.g., Lyznik et al., *Plant Mol. Biol.* 13:151-161 (1989), heat shock, lipofection, and particle bombardment (see, e.g., Klein et al., *Plant Physiol.* 91:440-444 (1989) and Boynton et al., *Science* 240(4858):1534-1538 (1988)). Transformation can also be accomplished using chloroplast transformation as described in, for example, Svab et al., *Proc. Natl Acad. Sci.* 87:8526-30 (1990).

Plant transformation strategies are described in, for example, U.S. Pat. No. 5,159,135 (cotton), U.S. Pat. No. 5,981,840 (corn), U.S. Pat. No. 5,914,451 (soybean), and WO 00/12715 (*eucalyptus*), which are incorporated by reference in their entirety. Additional plant transformation strategies and techniques are reviewed in Birch, R. G., *Ann. Rev. Plant Physiol. Plant Mol. Biol.* 48:297 (1997) and Forester et al., *Exp. Agric.* 33:15-33 (1997), and are incorporated by reference in their entirety Methods for transforming tree species are well known in the art. In accordance with one embodiment of the invention, genotype-independent transformation of *Eucalyptus* explants and generation of transgenic progeny can be accomplished by transformation using *Agrobacterium*. A tree explant can be, although need not be, harvested and cultured on a pre-culture medium before transformation. Although a pre-culture medium is not necessary, use of such a medium can increase transformation efficiency and plant regeneration. A pre-culture medium is a nutrient medium upon which plant explants can be cultured before transformation with *Agrobacterium*. Any pre-culture media and time periods of culture can be used. The pre-culture medium contains an *Agrobacterium* inducer, such as acetosyringone. The pre-culture medium can optionally contain plant growth regulators, including auxin and cytokinin. Pre-culture medium can be prepared using and appropriate salt medium, including, but not limited to Woody Plant Medium (WPM) salts (Lloyd and McCown, *Combined Proceedings of the International Plant Propagators Society* 30:421-427,1980), Murashige and Skoog medium (Sigma Aldrich, St. Louis, Mo.) or Lepoivre medium. The pre-culture medium can contain *Agrobacterium* inducers, such as, for example acetosyringone. Optionally, pre-culture medium can contain auxin, cytokinin, or both auxin and cytokinin. An exemplary plant pre-culture medium is shown in TABLE 5.

TABLE 5

Exemplary Plant Pre-Culture Medium.

| Medium Components | Amount per Liter of Medium |
| --- | --- |
| WPM salts | 1 package (Sigma) |
| $Ca(NO_3)_2 \cdot 4H_2O$ | 3.7 g |
| $MgSO_4 \cdot 4H_2O$ | 0.37 g |
| Nicotinic Acid | 0.5 mg |
| Thiamine•HCl | 0.5 mg |
| Pyridoxin•HCl | 0.5 mg |
| D-Pantothenic Acid | 1.0 mg |
| Myo-inositol | 0.1 g |
| BA | 0.1-1 mg |
| Bacto-agar | 5-8 g |
| Acetosyringone | 5-200 mg |
| NAA | 0.2-3 mg |
| zeatin | 1-6 mg |

In this transformation method, plant explants can be pre-cultured for four days in the dark on the pre-culture medium. Induced *Agrobacterium* culture can be prepared by methods known in the art. The induced culture is applied to a plant explant. Explants can be transformed by application of *Agrobacterium* culture to the explant, vacuum infiltration, floral dip, etc. Following transformation, *Agrobacterium* culture-treated explants can be co-cultivated with *Agrobacterium* under light or dark conditions for 2-10 days. In one embodiment, the explants are co-cultivated with *Agrobacterium* under light or dark conditions for 4 days.

Following co-cultivation, explants can be transferred to regeneration medium with 400 mg/L timentin. Explants can be cultured on regeneration medium before transfer to a selection medium. In one embodiment, explants are cultured on regeneration medium for four days. Any suitable selection medium can be used. In one embodiment, the selection medium is the regeneration medium supplemented with both timentin and an herbicide selection agent. TABLE 6 provides an exemplary regeneration medium.

TABLE 6

Exemplary Plant Regeneration Medium.

| Components for 1 Liter of Medium | Grams |
| --- | --- |
| $KNO_3$ | 1 |
| $NH_4H_2PO_4$ | 0.25 |
| $MgSO_4 \cdot 7H_2O$ | 0.25 |
| $CaCl_2 \cdot 2H_2O$ | 0.10 |
| $FeSO_4 \cdot 7H_2O$ | 0.0139 |
| $Na_2EDTA \cdot 2H_2O$ | 0.01865 |
| MES (Duchefa m1501) | 600.0 |
| MS Micro (½ strength) | |
| $MnSO_4 \cdot H_2O$ | 0.00845 |
| $ZnSO_4 \cdot 7H_2O$ | 0.0043 |

TABLE 6-continued

Exemplary Plant Regeneration Medium.

| | Grams |
|---|---|
| $CuSO_4 \cdot 5H_2O$ | 0.0000125 |
| $CoCl_2 \cdot 6H_2O$ | 0.0000125 |
| KI | 0.000415 |
| $H_3BO_3$ | 0.0031 |
| $Na_2MoO_4 \cdot 2H_2O$ | 0.000125 |
| Plant Growth Regulators | |
| Zeatin | |
| NAA (naphthalene acetic acid) | |
| Sugars | |
| Glucose/Sucrose | 20.0 |
| Myo-inositol | 0.100 |
| Amino Acid and Vitamin Mix | |
| Nicotinic Acid | 0.010 |
| Thiamine | 0.010 |
| Ca Pantothenate | 0.001 |
| Pyridoxine | 0.001 |
| Biotin | 0.00001 |
| Ascorbic Acid | 0.050 |
| L-glutamine | 0.1 |
| Arginine | 0.0258 |
| Glycine | 0.00199 |
| Lysine | 0.0508 |
| Methionine | 0.0132 |
| Phenylalanine | 0.0257 |
| Serine | 0.00904 |
| Threonine | 0.00852 |
| Tryptophan | 0.0122 |
| Tyrosine | 0.0127 |
| Gelling Agent | |
| Gelrite | 3.0 |

Shoot clumps that survive selection are maintained on regeneration medium containing herbicide and timentin. The shoot clumps can be transferred until shoots proliferate and initially elongate. In one embodiment, the shoot clumps are transferred every 3 weeks. Any reporter gene can be used, such as, for example, GFP, luciferase, or GUS. See, e.g., B. Miki and S. McHugh, *J. Biotechnol.* 107(3):193-232 (2004).

In one embodiment, GUS staining can performed to monitor the frequency of *Agrobacterium* infection and to ensure that the selected shoots are not escapes or chimeras. Leaf and stem tissues from the regenerated shoots can be stained for reporter gene expression immediately upon shoot development. For example, to determine GUS activity, the explants can be incubated in a substrate comprising 100 mM phosphate buffer (pH 7.0), 0.05% dimethyl suphoxide, 0.05% Triton X-100, 10 mM EDTA, 0.5 mM potassium ferrocyanide, and 1.5 mg/ml 5-bromo-4-chloro-3-indolyl-β-D-glucuronide (X-gluc). The explants can then be subjected to 10 minutes of vacuum before an overnight incubation at 37° C. prior to counting GUS foci.

In accordance with another embodiment, transformation of *Pinus* is accomplished using the methods described in U.S. Patent Application Publication No. 2002/0100083.

C. Compositions and Methods for Enhancing Woody Plants

Another aspect of the invention provides methods of obtaining wood and/or making wood pulp from a plant transformed with a DNA construct of the invention. Methods of producing a transgenic plant are provided above and are known in the art. A transformed plant can be cultured or grown under any suitable conditions. For example, pine can be cultured and grown as described in U.S. Patent Application Publication No. 2002/0100083. *Eucalyptus* can be cultured and grown as in, for example, Rydelius, et al., "Growing *Eucalyptus* for Pulp and Energy," presented at the Mechanization in Short Rotation, Intensive Culture Forestry Conference, Mobile, Ala., 1994. Wood and wood pulp can be obtained from the plant by any means known in the art.

As noted above, the wood or wood pulp obtained in accordance with this invention may demonstrate improved characteristics including, but not limited to any one or more of lignin composition, lignin structure, wood composition, cellulose polymerization, fiber dimensions, ratio of fibers to other plant components, plant cell division, plant cell development, number of cells per unit area, cell size, cell shape, cell wall composition, rate of wood formation, aesthetic appearance of wood, formation of stem defects, rate of growth, rate of root formation ratio of root to branch vegetative development, leaf area index, and leaf shape include increased or decreased lignin content, increased accessibility of lignin to chemical treatments, improved reactivity of lignin, increased or decreased cellulose content increased dimensional stability, increased tensile strength, increased shear strength, increased compression strength, increased shock resistance, increased stiffness, increased or decreased hardness, decreased spirality, decreased shrinkage, and differences in weight, density, and specific gravity.

II. Expression Profiling of Cell Signaling Genes

The present invention also provides methods and tools for performing expression profiling of cell signaling genes. Expression profiling is useful in determining whether genes are transcribed or translated, comparing transcript levels for particular genes in different tissues, genotyping, estimating DNA copy number, determining identity of descent, measuring mRNA decay rates, identifying protein binding sites, determining subcellular localization of gene products, correlating gene expression to a phenotype or other phenomenon, and determining the effect on other genes of the manipulation of a particular gene. Expression profiling is particularly useful for identifying gene expression in complex, multigenic events. For this reason, expression profiling is useful in correlating polysaccharide synthesis gene expression to plant phenotype and formation of plant tissues and the interconnection thereof to the polysaccharide biosynthesis.

Only a small fraction of a plant's cell signaling genes are expressed at a given time in a given tissue sample, and all of the expressed genes may not affect the plant phenotype. To identify genes capable of affecting a phenotype of interest, the present invention provides methods and tools for determining, for example, a cell signaling gene expression profile at a given point in plant development and a cell signaling gene expression profile a given tissue sample. The invention also provides methods and tools for identifying cell signaling genes whose expression can be manipulated to alter plant phenotype. In support of these methods, the invention also provides methods and tools that distinguish expression of different genes of the same family, such as, for example, MAP Kinase and MAP kinase kinase proteins.

As used herein, "gene expression" refers to the process of transcription of a DNA sequence into an RNA sequence, followed by translation of the RNA into a protein, which may or may not undergo post-translational processing. Thus, the relationship between plant phenotype and cell signaling gene expression can be observed by detecting, quantitatively or qualitatively, changes in the level of RNA or protein. As used herein, the term "biological activity" includes, but is not limited to, the activity of a protein gene product, including enzyme activity, such as, for example, kinase activity.

The present invention provides oligonucleotides that are useful in these expression profiling methods. Each oligonucleotide is capable of hybridizing under a given set of conditions to a cell signaling gene or gene product. In one aspect of the invention, a plurality of oligonucleotides is provided, wherein each oligonucleotide hybridizes under a given set of conditions to a different cell signaling gene product. Examples of oligonucleotides of the present invention include SEQ ID NOs: 395-583. Each of the oligos of SEQ ID NOs 395-583 hybridizes under standard conditions to a different gene product of one of SEQ ID NOs: 1-197. The oligonucleotides of the invention are useful in determining the expression of one or more cell signaling genes in any of the above-described methods.

A. Cell, Tissue, Nucleic Acid, and Protein Samples

Samples for use in methods of the present invention may be derived from plant tissue. Suitable plant tissues include, but are not limited to, somatic embryos, pollen, leaves, stems, calli, stolons, microtubers, shoots, xylem, male strolbili, pollen cones, vascular tissue, apical meristem, vascular cambium, xylem, root, flower, and seed.

According to the present invention "plant tissue" is used as described previously herein. Plant tissue can be obtained from any of the plants types or species described supra.

In accordance with one aspect of the invention, samples can be obtained from plant tissue at different developmental stages, from plant tissue at various times of the year (e.g. spring versus summer), from plant tissues subject to different environmental conditions (e.g. variations in light and temperature) and/or from different types of plant tissue and cells. In accordance with one embodiment, plant tissue is obtained during various stages of maturity and during different seasons of the year. In a further embodiment, plant tissue is obtained from plants displaying different phenotypes. For example, plant tissue can be collected from stem dividing cells, differentiating xylem, early developing wood cells, differentiated early wood cells, and differentiated late wood cells. As another example, gene expression in a sample obtained from a plant with developing wood can be compared to gene expression in a sample obtained from a plant which does not have developing wood. As a further example, gene expression in a sample obtained from a plant displaying a reaction wood phenotype, such as compression wood or tension wood, can be compared to gene expression in a sample obtained from a plant which does not have reaction wood.

Differentiating xylem includes samples obtained from reaction wood. Reaction wood includes compression wood, side-wood, tension wood, and normal vertical xylem. Methods of obtaining samples for expression profiling from pine and *eucalyptus* are known. See, e.g., Allona et al., *Proc. Nat'l Acad. Sci.* 95:9693-8 (1998) and Whetton et al., *Plant Mol. Biol.* 47:275-91, and Kirst et al., *Int'l Union of Forestry Research Organizations Biennial Conference*, S6.8 (June 2003, Umea, Sweden).

In one embodiment of the invention, gene expression in one type of tissue is compared to gene expression in a different type of tissue or to gene expression in the same type of tissue in a difference stage of development. Gene expression can also be compared in one type of tissue which is sampled at various times during the year (different seasons). For example, gene expression in juvenile secondary xylem can be compared to gene expression in mature secondary xylem. Similarly, gene expression in cambium can be compared to gene expression in xylem. Furthermore, gene expression in apical meristems can be compared to gene expression in cambium.

In another embodiment of the invention, a sample is obtained from a plant having a specific phenotype and gene expression in that sample is compared to a sample obtained from a plant of the same species that does not have that phenotype. For example, a sample can be obtained from a plant exhibiting a fast rate of growth and gene expression can be compared with that of a sample obtained from a plant exhibiting a normal or slow rate of growth. Differentially expressed genes identified from such a comparison can be correlated with growth rate and, therefore, useful for manipulating growth rate.

In a further embodiment, a sample is obtained from clonally propagated plants. In one embodiment the clonally propagated plants are of the species *Pinus* or *Eucalyptus*. Individual ramets from the same genotype can be sacrificed at different times of year. Thus, for any genotype there can be at least two genetically identical trees sacrificed, early in the season and late in the season. Each of these trees can be divided into juvenile (top) to mature (bottom) samples. Further, tissue samples can be divided into, for example, phloem to xylem, in at least 5 layers of peeling. Each of these samples can be evaluated for phenotype and gene expression.

Where cellular components may interfere with an analytical technique, such as a hybridization assay, enzyme assay, a ligand binding assay, or a biological activity assay, it may be desirable to isolate the gene products from such cellular components. Gene products, including nucleic acid and amino acid gene products, can be isolated from cell fragments or lysates by any method known in the art.

Nucleic acids used in accordance with the invention can be prepared by any available method or process, or by other processes as they become known in the art. Conventional techniques for isolating nucleic acids are detailed, for example, in Tijssen, *Laboratory Techniques in Biochemistry and Molecular Biology*, Hybridization With Nucleic Acid Probes, chapter 3 (Elsevier Press, 1993), Berger and Kimmel, *Methods Enzymol.* 152:1 (1987), and Gibco BRL & Life Technologies Trizol RNA Isolation Protocol, Form No. 3786 (2000). Techniques for preparing nucleic acid samples, and sequencing polynucleotides from pine and *eucalyptus* are known. See, e.g., Allona et al., supra and Whetton et al., supra.

A suitable nucleic acid sample can contain any type of nucleic acid derived from the transcript of a cell signaling gene, i.e., RNA or a subsequence thereof or a nucleic acid for which an mRNA transcribed from a cell signaling gene served as a template. Suitable nucleic acids include cDNA reverse-transcribed from a transcript, RNA transcribed from that cDNA, DNA amplified from the cDNA, and RNA transcribed from the amplified DNA. Detection of such products or derived products is indicative of the presence and/or abundance of the transcript in the sample. Thus, suitable samples include, but are not limited to, transcripts of the gene or genes, cDNA reverse-transcribed from the transcript, cRNA transcribed from the cDNA, DNA amplified from the genes, and RNA transcribed from amplified DNA. As used herein, the category of "transcripts" includes but is not limited to pre-mRNA nascent transcripts, transcript processing intermediates, and mature mRNAs and degradation products thereof.

It is not necessary to monitor all types of transcripts to practice the invention. For example, the expression profiling methods of the invention can be conducted by detecting only one type of transcript, such as mature mRNA levels only.

In one aspect of the invention, a chromosomal DNA or cDNA library (comprising, for example, fluorescently labeled cDNA synthesized from total cell mRNA) is prepared for use in hybridization methods according to recognized methods in the art. See Sambrook et al., supra.

In another aspect of the invention, mRNA is amplified using, e.g., the MessageAmp kit (Ambion). In a further aspect, the mRNA is labeled with a detectable label. For example, mRNA can be labeled with a fluorescent chromophore, such as CyDye (Amersham Biosciences).

In some applications, it may be desirable to inhibit or destroy RNase that often is present in homogenates or lysates, before use in hybridization techniques. Methods of inhibiting or destroying nucleases are well known. In one embodiment of the invention, cells or tissues are homogenized in the presence of chaotropic agents to inhibit nuclease. In another embodiment, RNase is inhibited or destroyed by heat treatment, followed by proteinase treatment.

Protein samples can be obtained by any means known in the art. Protein samples useful in the methods of the invention include crude cell lysates and crude tissue homogenates. Alternatively, protein samples can be purified. Various methods of protein purification well known in the art can be found in Marshak et al., *Strategies for Protein Purification and Characterization: A Laboratory Course Manual*, Cold Spring Harbor Laboratory Press, Cold Spring Harbor, N.Y. (1996).

B. Detecting Levels of Gene Expression

For methods of the invention that comprise detecting a level of gene expression, any method for observing gene expression can be used, without limitation. Such methods include traditional nucleic acid hybridization techniques, polymerase chain reaction (PCR) based methods, and protein determination. The invention includes detection methods that use solid support-based assay formats as well as those that use solution-based assay formats.

Absolute measurements of the expression levels need not be made, although they can be made. The invention includes methods comprising comparisons of differences in expression levels between samples. Comparison of expression levels can be done visually or manually, or can be automated and done by a machine, using for example optical detection means. Subrahmanyam et al., *Blood.* 97: 2457 (2001); Prashar et al., *Methods Enzymol.* 303: 258 (1999). Hardware and software for analyzing differential expression of genes are available, and can be used in practicing the present invention. See, e.g., GenStat Software and GeneExpress® GX Explorer™ Training Manual, supra; Baxevanis & Francis-Ouellette, supra.

In accordance with one embodiment of the invention, nucleic acid hybridization techniques are used to observe gene expression. Exemplary hybridization techniques include Northern blotting, Southern blotting, solution hybridization, and S1 nuclease protection assays.

Nucleic acid hybridization typically involves contacting an oligonucleotide probe and a sample comprising nucleic acids under conditions where the probe can form stable hybrid duplexes with its complementary nucleic acid through complementary base pairing. For example, see PCT application WO 99/32660; Berger & Kimmel, *Methods Enzymol.* 152: 1 (1987). The nucleic acids that do not form hybrid duplexes are then washed away leaving the hybridized nucleic acids to be detected, typically through detection of an attached detectable label. The detectable label can be present on the probe, or on the nucleic acid sample. In one embodiment, the nucleic acids of the sample are detectably labeled polynucleotides representing the mRNA transcripts present in a plant tissue (e.g., a cDNA library). Detectable labels are commonly radioactive or fluorescent labels, but any label capable of detection can be used. Labels can be incorporated by several approached described, for instance, in WO 99/32660, supra. In one aspect RNA can be amplified using the MessageAmp kit (Ambion) with the addition of aminoallyl-UTP as well as free UTP. The aminoallyl groups incorporated into the amplified RNA can be reacted with a fluorescent chromophore, such as CyDye (Amersham Biosciences)

Duplexes of nucleic acids are destabilized by increasing the temperature or decreasing the salt concentration of the buffer containing the nucleic acids. Under low stringency conditions (e.g., low temperature and/or high salt) hybrid duplexes (e.g., DNA:DNA, RNA:RNA or RNA:DNA) will form even where the annealed sequences are not perfectly complementary. Thus, specificity of hybridization is reduced at lower stringency. Conversely, at higher stringency (e.g., higher temperature and/or lower salt and/or in the presence of destabilizing reagents) hybridization tolerates fewer mismatches.

Typically, stringent conditions for short probes (e.g., 10 to 50 nucleotide bases) will be those in which the salt concentration is at least about 0.01 to 1.0 M at pH 7.0 to 8.3 and the temperature is at least about 30° C. Stringent conditions can also be achieved with the addition of destabilizing agents such as formamide.

Under some circumstances, it can be desirable to perform hybridization at conditions of low stringency, e.g., 6× SSPE-T (0.9 M NaCl, 60 mM $NaH_2PO_4$, pH 7.6, 6 mM EDTA, 0.005% Triton) at 37° C., to ensure hybridization. Subsequent washes can then be performed at higher stringency (e.g., 1× SSPE-T at 37° C.) to eliminate mismatched hybrid duplexes. Successive washes can be performed at increasingly higher stringency (e.g., down to as low as 0.25× SSPE-T at 37° C. to 50° C.) until a desired level of hybridization specificity is obtained.

In general, standard conditions for hybridization is a compromise between stringency (hybridization specificity) and signal intensity. Thus, in one embodiment of the invention, the hybridized nucleic acids are washed at successively higher stringency conditions and read between each wash. Analysis of the data sets produced in this manner will reveal a wash stringency above which the hybridization pattern is not appreciably altered and which provides adequate signal for the particular oligonucleotide probes of interest. For example, the final wash may be selected as that of the highest stringency that produces consistent results and that provides a signal intensity greater than approximately 10% of the background intensity.

1. Oligonucleotide Probes

Oligonucleotide probes useful in nucleic acid hybridization techniques employed in the present invention are capable of binding to a nucleic acid of complementary sequence through one or more types of chemical bonds, usually through complementary base pairing via hydrogen bond formation. A probe can include natural bases (i.e., A, G, U, C or T) or modified bases (7-deazaguanosine, inosine, etc.). In addition, the nucleotide bases in the probes can be joined by a linkage other than a phosphodiester bond, so long as it does not interfere with hybridization. Thus, probes can be peptide nucleic acids in which the constituent bases are joined by peptide bonds rather than phosphodiester linkages.

Oligonucleotide probes can be prepared by any means known in the art. Probes useful in the present invention are capable of hybridizing to a nucleotide product of a cell signaling gene, such as one of SEQ ID NOs: 1-197. Probes useful in the invention can be generated using the nucleotide sequences disclosed in SEQ ID NOs: 1-197. The invention includes oligonucleotide probes having at least a 2, 10,15, 20, 30, 35, 40, 45, 50, 55, 60, 65, 70, 75, 80, 85, or 100 nucleotide fragment of a corresponding contiguous sequence of any one of SEQ ID NOs: 1-197. The invention includes oligonucleotides of less than 2, 1, 0.5, 0.1, or 0.05 kb in length. In one embodiment, the oligonucleotide is 60 nucleotides in length. In another embodiment, the oligonucleotide is 30 nucleotides in length.

Oligonucleotide probes can be designed by any means known in the art. See, e.g., Li and Stormo, *Bioinformatics* 17: 1067-76 (2001). Oligonucleotide probe design can be effected using software. Exemplary software includes Array-Designer, GeneScan, and ProbeSelect. Probes complementary to a defined nucleic acid sequence can be synthesized chemically, generated from longer nucleotides using restriction enzymes, or can be obtained using techniques such as polymerase chain reaction (PCR). PCR methods are well known and are described, for example, in Innis et al. eds., *PCR Protocols: A Guide to Methods and Applications*, Academic Press Inc. San Diego, Calif. (1990). The probes can be labeled, for example, with a radioactive, biotinylated, or fluorescent tag. Optimally, the nucleic acids in the sample are labeled and the probes are not labeled. Oligonucleotide probes generated by the above methods can be used in solution or solid support-based methods.

The invention includes oligonucleotide probes that hybridize to a product of the coding region or a 3' untranslated region (3' UTR) of a cell signaling gene. In one embodiment, the oligonucleotide probe hybridizes to the 3' UTR of any one of SEQ ID NOs: 1-197. The 3' UTR is generally a unique region of the gene, even among members of the same family. Therefore, the probes capable of hybridizing to a product of the 3' UTR can be useful for differentiating the expression of individual genes within a family where the coding region of the genes likely are highly homologous. This allows for the design of oligonucleotide probes to be used as members of a plurality of oligonucleotides, each capable of uniquely binding to a single gene. In another embodiment, the oligonucleotide probe comprises any one of SEQ ID NOs: 395-583. In another embodiment, the oligonucleotide probe consists of any one of SEQ ID NOs: 1-197.

2. Oligonucleotide Array Methods

One embodiment of the invention employs two or more oligonucleotide probes in combination to detect a level of expression of one or more cell signaling genes, such as the genes of SEQ ID NOs: 1-197. In one aspect of this embodiment, the level of expression of two or more different genes is detected. The two or more genes may be from the same or different cell signaling gene families. Each of the two or more oligonucleotides may hybridize to a different one of the genes.

One embodiment of the invention employs two or more oligonucleotide probes, each of which specifically hybridize to a polynucleotide derived from the transcript of a gene provided by SEQ ID NOs: 1-197. Another embodiment employs two or more oligonucleotide probes, at least one of which comprises a nucleic acid sequence of SEQ ID NOs: 395-583. Another embodiment employs two or more oligonucleotide probes, at least one of which consists of SEQ ID NOs: 395-583.

The oligonucleotide probes may comprise from about 5 to about 60, or from about 5 to about 500, nucleotide bases, such as from about 60 to about 100 nucleotide bases, including from about 15 to about 60 nucleotide bases.

One embodiment of the invention uses solid support-based oligonucleotide hybridization methods to detect gene expression. Solid support-based methods suitable for practicing the present invention are widely known and are described, for example, in PCT application WO 95/11755; Huber et al., *Anal. Biochem.* 299: 24 (2001); Meiyanto et al., *Biotechniques*. 31: 406 (2001); Relogio et al., *Nucleic Acids Res.* 30:e51 (2002). Any solid surface to which oligonucleotides can be bound, covalently or non-covalently, can be used. Such solid supports include filters, polyvinyl chloride dishes, silicon or glass based chips, etc.

One embodiment uses oligonucleotide arrays, i.e. microarrays, which can be used to simultaneously observe the expression of a number of genes or gene products. Oligonucleotide arrays comprise two or more oligonucleotide probes provided on a solid support, wherein each probe occupies a unique location on the support. The location of each probe may be predetermined, such that detection of a detectable signal at a given location is indicative of hybridization to an oligonucleotide probe of a known identity. Each predetermined location can contain more than one molecule of a probe, but each molecule within the predetermined location has an identical sequence. Such predetermined locations are termed features. There can be, for example, from 2, 10, 100, 1,000, 2,000 or 5,000 or more of such features on a single solid support. In one embodiment, each oligonucleotide is located at a unique position on an array at least 2, at least 3, at least 4, at least 5, at least 6, or at least 10 times.

Oligonucleotide probe arrays for detecting gene expression can be made and used according to conventional techniques described, for example, in Lockhart et al., Nat'l Biotech. 14: 1675 (1996), McGall et al., *Proc. Nat'l Acad. Sci. USA* 93: 13555 (1996), and Hughes et al., *Nature Biotechnol.* 19:342 (2001). A variety of oligonucleotide array designs is suitable for the practice of this invention.

In one embodiment the one or more oligonucleotides include a plurality of oligonucleotides that each hybridize to a different gene expressed in a particular tissue type. For example, the tissue can be developing wood.

In one embodiment, a nucleic acid sample obtained from a plant can be amplified and, optionally labeled with a detectable label. Any method of nucleic acid amplification and any detectable label suitable for such purpose can be used. For example, amplification reactions can be performed using, e.g. Ambion's MessageAmp, which creates "antisense" RNA or "aRNA" (complementary in nucleic acid sequence to the RNA extracted from the sample tissue). The RNA can optionally be labeled using CyDye fluorescent labels. During the amplification step, aaUTP is incorporated into the resulting aRNA. The CyDye fluorescent labels are coupled to the aaUTPs in a non-enzymatic reaction. Subsequent to the amplification and labeling steps, labeled amplified antisense RNAs are precipitated and washed with appropriate buffer, and then assayed for purity. For example, purity can be assay using a NanoDrop spectrophotometer. The nucleic acid sample is then contacted with an oligonucleotide array having, attached to a solid substrate (a "microarray slide"), oligonucleotide sample probes capable of hybridizing to nucleic acids of interest which may be present in the sample. The step of contacting is performed under conditions where hybridization can occur between the nucleic acids of interest and the oligonucleotide probes present on the array. The array is then washed to remove non-specifically bound nucleic acids and the signals from the labeled molecules that remain hybridized to oligonucleotide probes on the solid substrate are detected. The step of detection can be accomplished using any method appropriate to the type of label used. For example, the step of detecting can accomplished using a laser scanner and detector. For example, on can use and Axon scanner which optionally uses GenePix Pro software to analyze the position of the signal on the microarray slide.

Data from one or more microarray slides can be analyzed by any appropriate method known in the art.

Oligonucleotide probes used in the methods of the present invention, including microarray techniques, can be generated using PCR. PCR primers used in generating the probes are chosen, for example, based on the sequences of SEQ ID NOs: 1-197, to result in amplification of unique fragments of cell signaling genes (i.e., fragments that hybridize to only one polynucleotide of any one of SEQ ID NOs: 1-197 under standard hybridization conditions). Computer programs are useful in the design of primers with the required specificity and optimal hybridization properties. For example, Li and Stormo, supra, discuss a method of probe selection using ProbeSelect which selects an optimum oligonucleotide probe based on the entire gene sequence as well as other gene sequences to be probed at the same time.

In one embodiment, oligonucleotide control probes also are used. Exemplary control probes can fall into at least one of three categories referred to herein as (1) normalization controls, (2) expression level controls and (3) negative controls. In microarray methods, one or more of these control probes may be provided on the array with the inventive cell signaling gene-related oligonucleotides.

Normalization controls correct for dye biases, tissue biases, dust, slide irregularities, malformed slide spots, etc. Normalization controls are oligonucleotide or other nucleic acid probes that are complementary to labeled reference oligonucleotides or other nucleic acid sequences that are added to the nucleic acid sample to be screened. The signals obtained from the normalization controls, after hybridization, provide a control for variations in hybridization conditions, label intensity, reading efficiency and other factors that can cause the signal of a perfect hybridization to vary between arrays. In one embodiment, signals (e.g., fluorescence intensity or radioactivity) read from all other probes used in the method are divided by the signal from the control probes, thereby normalizing the measurements.

Virtually any probe can serve as a normalization control. Hybridization efficiency varies, however, with base composition and probe length. Preferred normalization probes are selected to reflect the average length of the other probes being used, but they also can be selected to cover a range of lengths. Further, the normalization control(s) can be selected to reflect the average base composition of the other probes being used. In one embodiment, only one or a few normalization probes are used, and they are selected such that they hybridize well (i.e., without forming secondary structures) and do not match any test probes. In one embodiment, the normalization controls are mammalian genes.

Expression level control probes hybridize specifically with constitutively expressed genes present in the biological sample. Virtually any constitutively expressed gene provides a suitable target for expression level control probes. Typically, expression level control probes have sequences complementary to subsequences of constitutively expressed "housekeeping genes" including, but not limited to certain photosynthesis genes.

As used herein, "negative control" probes are not complementary to any of the test oligonucleotides (i.e., the inventive cell signaling gene-related oligonucleotides), normalization controls, or expression controls. In one embodiment, the negative control is a mammalian gene which is not complementary to any other sequence in the sample.

The terms "background" and "background signal intensity" refer to hybridization signals resulting from non-specific binding or other interactions between the labeled target nucleic acids (i.e., mRNA present in the biological sample) and components of the oligonucleotide array. Background signals also can be produced by intrinsic fluorescence of the array components themselves.

A single background signal can be calculated for the entire array, or a different background signal can be calculated for each target nucleic acid. In a one embodiment, background is calculated as the average hybridization signal intensity for the lowest 5 to 10 percent of the oligonucleotide probes being used, or, where a different background signal is calculated for each target gene, for the lowest 5 to 10 percent of the probes for each gene. Where the oligonucleotide probes corresponding to a particular cell signaling gene hybridize well and, hence, appear to bind specifically to a target sequence, they should not be used in a background signal calculation. Alternatively, background can be calculated as the average hybridization signal intensity produced by hybridization to probes that are not complementary to any sequence found in the sample (e.g., probes directed to nucleic acids of the opposite sense or to genes not found in the sample). In microarray methods, background can be calculated as the average signal intensity produced by regions of the array that lack any oligonucleotides probes at all.

3. PCR-Based Methods

In another embodiment, PCR-based methods are used to detect gene expression. These methods include reverse-transcriptase-mediated polymerase chain reaction (RT-PCR) including real-time and endpoint quantitative reverse-transcriptase-mediated polymerase chain reaction (Q-RTPCR). These methods are well known in the art. For example, methods of quantitative PCR can be carried out using kits and methods that are commercially available from, for example, Applied BioSystems and Stratagene®. See also Kochanowski, *Quantitative PCR Protocols* (Humana Press, 1999); Innis et al., supra.; Vandesompele et al., *Genome Biol.* 3: RESEARCH0034 (2002); Stein, *Cell Mol. Life Sci.* 59: 1235 (2002).

Gene expression can also be observed in solution using Q-RTPCR. Q-RTPCR relies on detection of a fluorescent signal produced proportionally during amplification of a PCR product. See Innis et al., supra. Like the traditional PCR method, this technique employs PCR oligonucleotide primers, typically 15-30 bases long, that hybridize to opposite strands and regions flanking the DNA region of interest. Additionally, a probe (e.g., TaqMan®, Applied Biosystems) is designed to hybridize to the target sequence between the forward and reverse primers traditionally used in the PCR technique. The probe is labeled at the 5' end with a reporter fluorophore, such as 6-carboxyfluorescein (6-FAM) and a quencher fluorophore like 6-carboxy-tetramethyl-rhodamine (TAMRA). As long as the probe is intact, fluorescent energy transfer occurs which results in the absorbance of the fluorescence emission of the reporter fluorophore by the quenching fluorophore. As Taq polymerase extends the primer, however, the intrinsic 5' to 3' nuclease activity of Taq degrades the probe, releasing the reporter fluorophore. The increase in the fluorescence signal detected during the amplification cycle is proportional to the amount of product generated in each cycle.

The forward and reverse amplification primers and internal hybridization probe is designed to hybridize specifically and uniquely with one nucleotide derived from the transcript of a target gene. In one embodiment, the selection criteria for primer and probe sequences incorporates constraints regarding nucleotide content and size to accommodate TaqMan® requirements.

SYBR Green® can be used as a probe-less Q-RTPCR alternative to the Taqman®-type assay, discussed above. ABI Prism® 7900 Sequence Detection System User Guide Applied Biosystems, chap. 1-8, App. A-F. (2002).

A device measures changes in fluorescence emission intensity during PCR amplification. The measurement is done in "real time," that is, as the amplification product accumulates in the reaction. Other methods can be used to measure changes in fluorescence resulting from probe digestion. For example, fluorescence polarization can distinguish between large and small molecules based on molecular tumbling (see, e.g., U.S. Pat. No. 5,593,867).

4. Protein Detection Methods

Proteins can be observed by any means known in the art, including immunological methods, enzyme assays and protein array/proteomics techniques.

Measurement of the translational state can be performed according to several protein methods. For example, whole genome monitoring of protein—the "proteome"—can be carried out by constructing a microarray in which binding sites comprise immobilized, preferably monoclonal, antibodies specific to a plurality of proteins having an amino acid sequence of any of SEQ ID NOs: 198-394 or proteins encoded by the genes of SEQ ID NOs: 1-197 or conservative variants thereof. See Wildt et al., *Nature Biotechnol.* 18: 989 (2000). Methods for making polyclonal and monoclonal antibodies are well known, as described, for instance, in Harlow & Lane, *Antibodies: A Laboratory Manual* (Cold Spring Harbor Laboratory Press, 1988).

Alternatively, proteins can be separated by two-dimensional gel electrophoresis systems. Two-dimensional gel electrophoresis is well-known in the art and typically involves isoelectric focusing along a first dimension followed by SDS-PAGE electrophoresis along a second dimension. See, e.g., Hames et al, *Gel Electrophoresis of Proteins: A Practical Approach* (IRL Press, 1990). The resulting electropherograms can be analyzed by numerous techniques, including mass spectrometric techniques, western blotting and immunoblot analysis using polyclonal and monoclonal antibodies, and internal and N-terminal micro-sequencing.

In another embodiment, cell signaling proteins can be detected by directly measuring their enzymatic activity. For example, cytokinin oxidase activity can be measured by a simple colormetric assay. See Libreros-Minotta et al., *Anal. Biochem.* 231:339-341 (1995). Likewise, cell signaling gene products can be detected directly or indirectly by the functional assays described supra in Part I.A. of this description.

C. Correlating Gene Expression to Phenotype

As discussed above, the invention provides methods and tools to correlate gene expression to plant phenotype. Gene expression may be examined in a plant having a phenotype of interest and compared to a plant that does not have the phenotype or has a different phenotype. Such a phenotype includes, but is not limited to, increased drought tolerance, herbicide resistance, reduced or increased height, reduced or increased branching, enhanced cold and frost tolerance, improved vigor, enhanced color, enhanced health and nutritional characteristics, improved storage, enhanced yield, enhanced salt tolerance, enhanced resistance of the wood to decay, enhanced resistance to fungal diseases, altered attractiveness to insect pests enhanced heavy metal tolerance, increased disease tolerance, increased insect tolerance, increased water-stress tolerance, enhanced sweetness, improved texture, decreased phosphate content, increased germination, increased micronutrient uptake, improved starch composition, improved flower longevity, production of novel resins, increased or decreased cellulose content, increased or decreased lignin content, increased or decreased nonlignin cell wall phenolics and production of novel proteins or peptides.

In another embodiment, the phenotype includes one or more of the following traits: propensity to form reaction wood, a reduced period of juvenility, an increased period of juvenility, self-abscising branches, accelerated reproductive development or delayed reproductive development, and accelerated regeneration.

In a further embodiment, the phenotype that is different from the comparative plant includes one or more of the following: lignin quality, lignin structure, wood composition, wood appearance, wood density, wood strength, wood stiffness, cellulose polymerization, fiber dimensions, lumen size, proportion of rays, proportion of vessel elements, other plant components, plant cell division, plant cell development, number of cells per unit area, cell size, cell shape, cell wall composition, proportion of nonlignin cell wall phenolics, rate of wood formation, aesthetic appearance of wood, formation of stem defects, average microfibril angle, width of the S2 cell wall layer, rate of growth, rate of root formation ratio of root to branch vegetative development, leaf area index, and leaf shape. Phenotype can be assessed by any suitable means as discussed above, such as, for example Hertzberg, supra, Ye and Sundström, supra, U.S. Patent Application Publication Nos. 2002/0107644 and 2002/0113212, Marita et al., supra.

It will be apparent to those skilled in the art that various modifications and variations can be made in the methods and compositions of the present invention without departing from the spirit or scope of the invention. Thus, it is intended that the present invention cover the modifications and variations of this invention provided they come within the scope of the appended claims and their equivalents.

The following examples are given to illustrate the present invention. It should be understood, however, that the invention is not to be limited to the specific conditions or details described in these examples. Throughout the specification, any and all references to a publicly available document, including a U.S. patent, are specifically incorporated by reference in their entirety.

EXAMPLES

Example 1

Example 1 demonstrates the isolation and characterization of cell signaling genes from *E. grandis* and *P. radiata*.

Total RNA was extracted from plant tissue (using the protocol of Chang et al., *Plant Mol. Biol. Rep.* 11:113-116 (1993). Plant tissue samples were obtained from phloem (P), cambium (C), expanding xylem (X1), and differentiating and lignifying xylem (X2).

mRNA was isolated from the total RNA preparation using either a Poly(A) Quik mRNA Isolation Kit (Stratagene, La Jolla, Calif.) or Dynal Beads Oligo (dT)$_{25}$ (Dynal, Skogen, Norway). cDNA expression libraries were constructed from the purified mRNA by reverse transcriptase synthesis followed by insertion of the resulting cDNA clones in Lambda ZAP using a ZAP Express cDNA Synthesis Kit (Stratagene), according to the using the manufacturer's protocol. The resulting cDNAs were packaged using a Gigapack II Packaging Extract (Stratagene) using an aliquot (1-5 µL) from the 5 µL ligation reaction dependent upon the library. Mass excision of the library was done using XL1-Blue MRF' cells and XLOLR cells (Stratagene) with ExAssist helper phage (Stratagene). The excised phagemids were diluted with NZY broth (Gibco BRL, Gaithersburg, Md.) and plated out onto LB-kanamycin agar plates containing X-gal and isopropylthio-beta-galactoside (IPTG).

Of the colonies plated and selected for DNA miniprep, 99% contained an insert suitable for sequencing. Positive colonies were cultured in NZY broth with kanamycin and cDNA was purified by means of alkaline lysis and polyethylene glycol (PEG) precipitation. Agarose gel at 1% was used to screen sequencing templates for chromosomal contamination. Dye primer sequences were prepared using a Turbo Catalyst 800 machine (Perkin Elmer/Applied Biosystems Division, Foster City, Calif.) according to the manufacturer's protocol.

DNA sequence for positive clones was obtained using a Perkin Elmer/Applied Biosystems Division Prism 377 sequencer. cDNA clones were sequenced first from the 5' end and, in some cases, also from the 3' end. For some clones, internal sequence was obtained using either Exonuclease III deletion analysis, yielding a library of differentially sized subclones in pBK-CMV, or by direct sequencing using gene-specific primers designed to identify regions of the gene of interest. The determined cDNA sequences are provided in SEQ ID NOS: 1-197. The predicted polypeptide sequences are SEQ ID NOs: 198-394.

To identify cell signaling gene candidates in *P. radiata* and *E. grandis* databases, cDNA sequences were compared to the *Arabidopsis* cell signaling gene superfamilies. Richmond and Somerville, *Plant Physiol.* 124:495 (2000).

Next, public domain sequences (by SWISS-PROT/TrEMBL ID's) were used to search against the pine and *eucalyptus* databases (non-redundant by contig, expect <$1.0e^{-2}$). Probably pine and *eucalyptus* gene candidates were obtained. Of these, several pine and *eucalyptus* gene candidates were potentially full length (i.e. contained start Met) or near full length sequences.

The contig consensus DNA and protein sequences were then obtained for all gene candidates and duplicate sequences were identified. Multiple alignment was then carried out with the protein sequences. The protein alignment was created using the remaining pine and *eucalyptus* sequences along with the *Arabidopsis* members, and previously identified cell signaling genes. From the protein alignment, a dendogram was created. This dendogram grouped the sequence hits into cell signaling families. These sequences were analyzed by primer walking to provide a full length sequence (best HT pick from the contig analyzed for full length sequence).

The public domain cell signaling sequences from maize, cotton, rice, and poplar were also extracted and blasted against the pine and *eucalyptus* databases. The completed primer walked pine and *eucalyptus* sequences were also blasted against ownseq and the top 500 hits were taken. This was done so that the sequences could be used to search further and ensure that nothing in the pine and *eucalyptus* databases had been missed by using the *Arabidopsis* superfamily. This search resulted in the identification of additional sequences not found in the previous searches. These sequences were then also sent for primer walked full length sequence.

After removing a small number of additional duplicates after primer walking, the pine and *eucalyptus* primer walked cell signaling genes were identified. The classification of these sequences was confirmed by alignment with ClustalX, the corresponding dendogram, and MEME/MAST analysis.

Example 2

Example 2 demonstrates how additional regions either 5' or 3' of target sequences are identified and characterized.

To identify additional sequence 5' or 3' of a partial cDNA sequence in a cDNA library, 5' and 3' rapid amplification of cDNA ends (RACE) was performed. using the SMART RACE cDNA amplification kit (Clontech Laboratories, Palo Alto, Calif.). Generally, the method entailed first isolating poly(A) mRNA, performing first and second strand cDNA synthesis to generate double stranded cDNA, blunting cDNA ends, and then ligating of the SMART RACE. Adaptor to the cDNA to form a library of adaptor-ligated ds cDNA. Gene-specific primers were designed to be used along with adaptor specific primers for both 5' and 3' RACE reactions. Using 5' and 3' RACE reactions, 5' and 3' RACE fragments were obtained, sequenced, and cloned. The process may be repeated until 5' and 3' ends of the full-length gene were identified. A full-length cDNA may generated by PCR using primers specific to 5' and 3, ends of the gene by end-to-end PCR.

For example, to amplify the missing 5' region of a gene from first-strand cDNA, a primer was designed 5'→3' from the opposite strand of the template sequence, and from the region between ~100-200 bp of the template sequence. A successful amplification should give an overlap of ~100 bp of DNA sequence between the 5' end of the template and PCR product.

RNA was extracted from four pine tissues, namely seedling, xylem, phloem and structural root using the Concert Reagent Protocol (Invitrogen, Carlsbad, Calif.) and standard isolation and extraction procedures. The resulting RNA was then treated with DNase, using 10 U/μl DNase I (Roche Diagnostics, Basel, Switzerland). For 100 μg of RNA, 9 μl 10× DNase buffer (Invitrogen, Carlsbad, Calif.), 10 μl of Roche DNase I and 90 μl of Rnase-free water was used. The RNA was then incubated at room temperature for 15 minutes and ¹⁄₁₀ volume 25 mM EDTA is added. A RNeasy mini kit (Qiagen, Venlo, The Netherlands) was used for RNA purification according to manufacturer's protocol.

To synthesize cDNA, the extracted RNA from xylem, phloem, seedling and root was used and the SMART RACE cDNA amplification kit (Clontech Laboratories Inc, Palo Alto, Calif.) was followed according to manufacturer's protocol. For the RACE PCR, the cDNA from the four tissue types was combined. The master mix for PCR was created by combining equal volumes of cDNA from xylem, phloem, root and seedling tissues. PCR reactions were performed in 96 well PCR plates, with 1 μl of primer from primer dilution plate (10 mM) to corresponding well positions. 49 μl of master mix is aliquoted into the PCR plate with primers. Thermal cycling commenced on a GeneAmp 9700 (Applied Biosystems, Foster City, Calif.) obtaining 94° C. for 5 seconds, 72° C. for 3 minutes, 5 cycles, 94° C. for 5 seconds, 70° C. for 10 seconds, and 72° C. for 3 minutes, repeated for 5 cycles. Subsequently, the thermal cycling occurred at 94° C. for 5 seconds, 68° C. for 10 sec, and 72° C. for 3 minutes, repeated for 25 cycles.

cDNA was separated on an agarose gel following standard procedures. Gel fragments were excised and eluted from the gel by using the Qiagen 96-well Gel Elution kit, following the manufacturer's instructions.

PCR products were ligated into pGEMTeasy (Promega, Madison, Wis.) in a 96 well plate overnight according to the following specifications: 60-80 ng of DNA, 5 μl 2× rapid ligation buffer, 0.5 μl pGEMT easy vector, 0.1 μl DNA ligase, filled to 10 μl with water, and incubated overnight.

Each clone was transformed into *E. coli* following standard procedures and DNA was extracted from 12 clones picked by following standard protocols. DNA extraction and the DNA quality was verified on an 1% agarose gel. The presence of the correct size insert in each of the clones was determined by restriction digests, using the restriction endonuclease EcoRI, and gel electrophoresis, following standard laboratory procedures.

The transformation of *Eucalyptus* elite clones with a sense UDP-glucose binding domain sequence operably-linked to a constitutive promoter confers an enhanced growth phenotype, as evidenced by increases in cellulose synthesis, primary cell wall synthesis, wood density, and tensile strength. Leaf explants are harvested from stock *Eucalyptus* plants and the explants are cultured on a pre-treatment medium. The pre-culture medium comprises auxin, cytokinin, and an *Agrobacterium* inducer, such as acetosyringone, to stimulate cell division along the excised edges of the tissue explant. Following four days of pre-culture, the explants are inoculated with *Agrobacterium* strain GV2260 containing a plasmid bearing a portion of the UDP-glucose binding domain operably linked to a ubiquitin promoter. The explants are co-cultivated for 3 days prior to transfer to Euc Regeneration medium. The explants are cultured on *Eucalyptus* Regeneration medium for 4 days before transfer to selection medium containing an herbicide.

Following the selection of herbicide-resistant transformants, the transformants are assayed for GUS expression. Upon the confirmation of GUS expression, shoots are harvested and transferred to a rooting medium. The rooting medium comprises BTM-1 salts supplemented with 5 g/l MeadWestvaco Nuchar activated carbon, and rooting development usually occurs after 2-4 weeks. Upon development of the primary root system, the transformed plants are transferred to soil. The transgenic *Eucalyptus* plants carrying any one of SEQ ID NOs. 1-197 operably linked to a ubiquitin promoter exhibit modulated growth rates, responses to environmental cues and altered phenotypic traits.

Example 3

Example 3 illustrates a procedure for RNA extraction and purification, which is particularly useful for RNA obtained from conifer needle, xylem, cambium, and phloem.

Tissue is obtained from conifer needle, xylem, cambium or phloem. The tissue is frozen in liquid nitrogen and ground. The total RNA is extracted using Concert Plant RNA reagent (Invitrogen). The resulting RNA sample is extracted into phenol:chloroform and treated with DNase. The RNA is then incubated at 65° C. for 2 minutes followed by centrifugation at 4° C. for 30 minutes. Following centrifugation, the RNA is extracted into phenol at least 10 times to remove contaminants.

The RNA is further cleaned using RNeasy columns (Qiagen). The purified RNA is quantified using RiboGreen reagent (Molecular Probes) and purity assessed by gel electrophoresis.

RNA is then amplified using MessageAmp (Ambion). Aminoallyl-UTP and free UTP are added to the in vitro transcription of the purified RNA at a ratio of 4:1 aminoallyl-UTP-to-UTP. The aminoallyl-UTP is incorporated into the new RNA strand as it is transcribed. The amino-allyl group is then reacted with Cy dyes to attach the calorimetric label to the resulting amplified RNA using the Amersham procedure modified for use with RNA. Unincorporated dye is removed by ethanol precipitation. The labeled RNA is quantified spectrophotometrically (NanoDrop). The labeled RNA is fragmented by heating to 95° C. as described in Hughes et al., *Nature Biotechnol.* 19:342 (2001).

Example 4

Example 4 illustrates how cell signaling genes important for wood development in *P. radiata* can be determined and how oligonucleotides which uniquely bind to those genes can be designed and synthesized for use on a microarray.

Pine trees of the species *P. radiata* are grown under natural light conditions. Tissue samples are prepared as described in, e.g., Sterky et al., *Proc. Nat'l Acad. Sci.* 95:13330 (1998). Specifically, tissue samples are collected from woody trees having a height of 5 meters. Tissue samples of the woody trees are prepared by taking tangential sections through the cambial region of the stem. The stems are sectioned horizontally into sections ranging from juvenile (top) to mature (bottom). The stem sections separated by stage of development are further separated into 5 layers by peeling into sections of phloem, differentiating phloem, cambium, differentiating xylem, developing xylem, and mature xylem. Tissue samples, including leaves, buds, shoots, and roots are also prepared from seedlings of the species *P. radiata*.

RNA is isolated and ESTs generated as described in Example 1 or Sterky et al., supra. The nucleic acid sequences of ESTs derived from samples containing developing wood are compared with nucleic acid sequences of genes known to be involved in cell signaling. ESTs from samples that do not contain developing wood are also compared with sequences of genes known to be involved in the plant growth and development. An in silico hybridization analysis can then be performed using BLAST (NCBI).

Sequences from among the known cell signaling genes that show hybridization in silico to ESTs made from samples containing developing wood, but that do not hybridize to ESTs from samples not containing developing wood are selected for further examination.

cDNA clones containing sequences that hybridize to the genes showing wood-preferred expression are selected from cDNA libraries using techniques well known in the art of molecular biology. Using the sequence information, oligonucleotides are designed such that each oligonucleotide is specific for only one cDNA sequence in the library. The oligonucleotide sequences are provided in TABLE 4. 60-mer oligonucleotide probes are designed using the method of Li and Stormo, supra or using software such as ArrayDesigner, GeneScan, and ProbeSelect.

The oligonucleotides are then synthesized in situ described in Hughes et al., *Nature Biotechnol.* 19:324 (2002) or as described in Kane et al., *Nucleic Acids Res.* 28:4552 (2000) and affixed to an activated glass slide (Sigma-Genosis, The Woodlands, Tex.) using a 5' amino linker. The position of each oligonucleotide on the slide is known.

Example 5

Example 5 illustrates how RNAs of tissues from multiple pine species, in this case both *P. radiata* and loblolly pine *P. taeda* trees, are selected for analysis of the pattern of gene expression associated with wood growth and development in the juvenile wood and mature wood forming sections of the trees using the microarrays derived from *P. radiata* cDNA sequences described in Example 4.

Open pollinated trees of approximately 16 years of age are selected from plantation-grown sites, in the United States for loblolly pine, and in New Zealand for radiata pine. Trees are felled during the spring and summer seasons to compare the expression of genes associated with these different developmental stages of wood formation. Trees are felled individually and trunk sections are removed from the bottom area approximately one to two meters from the base and within one to two meters below the live crown. The section removed from the basal end of the trunk contains mature wood. The section removed from below the live crown contains juvenile wood. Samples collected during the spring season are termed earlywood or springwood, while samples collected during the summer season are considered latewood or summerwood. Larson et al., *Gen. Tech. Rep.* FPL-GTR-129. Madison, Wis.: U.S. Department of Agriculture, Forest Service, Forest Products Laboratory. p. 42.

Tissues are isolated from the trunk sections such that phloem, cambium, developing xylem, and maturing xylem are removed. These tissues are collected only from the current year's growth ring. Upon tissue removal in each case, the material is immediately plunged into liquid nitrogen to preserve the nucleic acids and other components. The bark is peeled from the section and phloem tissue removed from the inner face of the bark by scraping with a razor blade. Cambium tissue is isolated from the outer face of the peeled section by gentle scraping of the surface. Developing xylem and lignifying xylem are isolated by sequentially performing more vigorous scraping of the remaining tissue. Tissues are transferred from liquid nitrogen into containers for long term storage at −70° C. until RNA extraction and subsequent analysis is performed.

Example 6

Example 6 illustrates procedures alternative to those used in Example 3 for RNA extraction and purification, particularly useful for RNA obtained from a variety of tissues of woody plants, and a procedure for hybridization and data analysis using the arrays described in Example 4.

RNA is isolated according to the protocol of Chang et al., *Plant Mol. Biol. Rep.* 11:113-116 (1993). DNA is removed using DNase I (Invitrogen, Carlsbad, Calif.) according to the manufacturer's recommendations. The integrity of the RNA samples is determined using the Agilent 2100 Bioanalyzer (Agilent Technologies, USA).

10 µg of total RNA from each tissue is reverse transcribed into cDNA using known methods.

In the case of *Pinus radiata* phloem tissue, it can be difficult to extract sufficient amounts of total RNA for normal labelling procedures. Total RNA is extracted and treated as previously described and 100 ng of total RNA is amplified using the Ovation™ Nanosample RNA Amplification system from NUGEN™ (NUGEN, Calif., USA). Similar amplification kits such as those manufactured by Ambion may alternatively be used. The amplified RNA is reverse transcribed into cDNA and labelled as described above.

Hybridization and stringency washes are performed using the protocol as described in the U.S. patent application for "Methods and Kits for Labeling and Hybridizing cDNA for Microarray Analysis" (supra) at 42 C. The arrays (slides) are scanned using a ScanArray 4000 Microarray Analysis System (GSI Lumonics, Ottawa, ON, Canada). Raw, non-normalized intensity values are generated using QUANTAR-RAY software (GSI Lumonics, Ottawa, ON, Canada).

A fully balanced, incomplete block experimental design (Kerr and Churchill, *Gen. Res.* 123:123, 2001) is used in order to design an array experiment that would allow maximum statistical inferences from analyzed data.

Gene expression data is analyzed using the SAS® Microarray Solution software package (The SAS Institute, Cary, N.C., USA). Resulting data was then visualized using JMP® (The SAS Institute, Cary, N.C., USA).

Analysis done for this experiment is an ANOVA approach with mixed model specification (Wolfinger et al., *J. Comp. Biol.* 8:625-637). Two steps of linear mixed models are applied. The first one, normalization model, is applied for global normalization at slide-level. The second one, gene model, is applied for doing rigorous statistical inference on each gene. Both models are stated in Models (1) and (2).

$$\log_2(Y_{ijkls}) = \theta_{ij} + D_k + S_l + DS_{kl} + \omega_{ijkls} \tag{1}$$

$$R_{ijkls}^{(g)} = \mu_{ij}^{(g)} + D_k^{(g)} + S_l^{(g)} + DS_{kl}^{(g)} + SS_{ls}^{(g)} + \epsilon_{ijkls}^{(g)} \tag{2}$$

$Y_{ijkls}$ represents the intensity of the $s^{th}$ spot in the $l^{th}$ slide with the $k^{th}$ dye applying the $j^{th}$ treatment for the $i^{th}$ cell line. $\theta_{ij}$, $D_k$, $S_l$, and $DS_{kl}$ represent the mean effect of the jth treatment in the ith cell line, the kth dye effect, the $l^{th}$ slide random effect, and the random interaction effect of the $k^{th}$ dye in the $l^{th}$ slide. $\omega_{ijkls}$ is the stochastic error term. represent the similar roles as $\theta_{ij}$, $D_k$, $S_l$, and $D_{Skl}$ except they are specific for the $g^{th}$ gene. $R_{ijkls}^{(g)}$ represents the residual of the $g^{th}$ gene from model (1). $\mu_{ij}^{(g)}$, $D_k^{(g)}$, $S_l^{(g)}$, and $DS_{kl}^{(g)}$ represent the similar roles as $\theta_{ij}$, $D_k$, $S_l$, and $DS_{kl}$ except they are specific for the $g^{th}$ gene. $SS_{ls}^{(g)}$ represent the spot by slide random effect for the $g^{th}$ gene. $\epsilon_{ijkls}^{(g)}$ represent the stochastic error term. All random terms are assumed to be normal distributed and mutually independent within each model.

According to the analysis described above, certain cDNAs can be shown to be differentially expressed.

The involvement of these specific genes in wood growth and development is inferred through the association of the up-regulation or down-regulation of genes to the particular stages of wood development. Both the spatial continuum of wood development across a section (phloem, cambium, developing xylem, maturing xylem) at a particular season and tree trunk position and the relationships of season and tree trunk position should be considered when making associations of gene expression to the relevance in wood development.

Example 7

Example 7 demonstrates how one can correlate cell signaling gene expression with agronomically important wood phenotypes such as density, stiffness, strength, distance between branches, and spiral grain.

Mature clonally propagated pine trees are selected from among the progeny of known parent trees for superior growth characteristics and resistance to important fungal diseases. The bark is removed from a tangential section and the trees are examined for average wood density in the fifth annual ring at breast height, stiffness and strength of the wood, and spiral grain. The trees are also characterized by their height, mean distance between major branches, crown size, and forking.

To obtain seedling families that are segregating for major genes that affect density, stiffness, strength, distance between branches, spiral grain and other characteristics that may be linked to any of the genes affecting these characteristics, trees lacking common parents are chosen for specific crosses on the criterion that they exhibit the widest variation from each other with respect to the density, stiffness, strength, distance between branches, and spiral grain criteria. Thus, pollen from a tree exhibiting high density, low mean distance between major branches, and high spiral grain is used to pollinate cones from the unrelated plus tree among the selections exhibiting the lowest density, highest mean distance between major branches, and lowest spiral grain. It is useful to note that "plus trees" are crossed such that pollen from a plus tree exhibiting high density are used to pollinate developing cones from another plus tree exhibiting high density, for example, and pollen from a tree exhibiting low mean distance between major branches would be used to pollinate developing cones from another plus tree exhibiting low mean distance between major branches.

Seeds are collected from these controlled pollinations and grown such that the parental identity is maintained for each seed and used for vegetative propagation such that each genotype is represented by multiple ramets. Vegetative propagation is accomplished using micropropagation, hedging, or fascicle cuttings. Some ramets of each genotype are stored while vegetative propagules of each genotype are grown to sufficient size for establishment of a field planting. The genotypes are arrayed in a replicated design and grown under field conditions where the daily temperature and rainfall are measured and recorded.

The trees are measured at various ages to determine the expression and segregation of density, stiffness, strength, distance between branches, spiral grain, and any other observable characteristics that may be linked to any of the genes affecting these characteristics. Samples are harvested for characterization of cellulose content, lignin content, cellulose microfibril angle, density, strength, stiffness, tracheid morphology, ring width, and the like. Samples are also examined for gene expression as described in Example 6. Ramets of each genotype are compared to ramets of the same genotype at different ages to establish age:age correlations for these characteristics.

Example 8

Example 8 demonstrates how responses to environmental conditions such as light and season alter plant phenotype and can be correlated to cell signaling gene expression using microarrays. In particular, the changes in gene expression associated with wood density are examined.

Trees of three different clonally propagated *E. grandis* hybrid genotypes are grown on a site with a weather station that measures daily temperatures and rainfall. During the spring and subsequent summer, genetically identical ramets of the three different genotypes are first photographed with north-south orientation marks, using photography at sufficient resolution to show bark characteristics of juvenile and mature portions of the plant, and then felled. The age of the trees is determined by planting records and confirmed by a count of the annual rings. In each of these trees, mature wood is defined as the outermost rings of the tree below breast height, and juvenile wood as the innermost rings of the tree above breast height. Each tree is accordingly sectored as follows:

NM—NORTHSIDE MATURE
SM—SOUTHSIDE MATURE
NT—NORTHSIDE TRANSITION
ST—SOUTHSIDE TRANSITION
NJ—NORTHSIDE JUVENILE
SJ—SOUTHSIDE JUVENILE

Tissue is harvested from the plant trunk as well as from juvenile and mature form leaves. Samples are prepared simultaneously for phenotype analysis, including plant morphology and biochemical characteristics, and gene expression analysis. The height and diameter of the tree at the point from which each sector was taken is recorded, and a soil sample from the base of the tree is taken for chemical assay. Samples prepared for gene expression analysis are weighed and placed into liquid nitrogen for subsequent preparation of RNA samples for use in the microarray experiment. The tissues are denoted as follows:

P—phloem
C—cambium
X1—expanding xylem
X2—differentiating and lignifying xylem

Thin slices in tangential and radial sections from each of the sectors of the trunk are fixed as described in Ruzin, *Plant Microtechnique and Microscopy*, Oxford University Press, Inc., New York, N.Y. (1999) for anatomical examination and confirmation of wood developmental stage. Microfibril angle is examined at the different developmental stages of the wood, for example juvenile, transition and mature phases of *Eucalyptus grandis* wood. Other characteristics examined are the ratio of fibers to vessel elements and ray tissue in each sector. Additionally, the samples are examined for characteristics that change between juvenile and mature wood and between spring wood and summer wood, such as fiber morphology, lumen size, and width of the S2 (thickest) cell wall layer. Samples are further examined for measurements of density in the fifth ring and determination of modulus of elasticity using techniques well known to those skilled in the art of wood assays. See, e.g., Wang, et al., Non-destructive Evaluations of Trees, *Experimental Techniques*, pp. 28-30 (2000).

For biochemical analysis, 50 grams from each of the harvest samples are freeze-dried and analyzed, using biochemical assays well known to those skilled in the art of plant biochemistry for quantities of simple sugars, amino acids, lipids, other extractives, lignin, and cellulose. See, e.g., Pettersen & Schwandt, *J. Wood Chem. & Technol.* 11:495 (1991).

In the present example, the phenotypes which can be chosen for comparison are high density wood, average density wood, and low density wood. Nucleic acid samples are prepared as described in Example 3, from trees harvested in the spring and summer. Gene expression profiling by hybridization and data analysis is performed as described above.

Using similar techniques and clonally propagated individuals one can examine cell signaling gene expression as it is related to other complex wood characteristics such as strength, stiffness and spirality.

Example 9

Example 9 demonstrates how a cell signaling gene can be linked to a tissue-preferred promoter and expressed in pine.

A cell signaling gene, which is more highly expressed during the early spring, is identified by the method described in Example 7. A DNA construct having the density-related polypeptide operably linked to a promoter is placed into an appropriate binary vector and transformed into pine using the methods described herein. Pine plants are transformed as described in herein and the transgenic pine plants are used to establish a forest planting. Increased density even in the spring wood (early wood) is observed in the transgenic pine plants relative to control pine plants which are not transformed with the density related DNA construct.

Example 10

Using techniques well known to those skilled in the art of molecular biology, the sequence of a cell signalling gene isolated in Example 9 can be analyzed in genomic DNA isolated from alfalfa. This enables the identification of an orthologue in alfalfa. The orthologue nucleotide sequence can then be used to create an RNAi knockout construct. This construct is then transformed into alfalfa. See, e.g., Austin et al.,. *Euphytica* 85, 381 (1995). The regenerated transgenic plants should demonstrate modulated growth, development or a perturbed ability to perceive and respond to environmental cues.

Example 11

Example 11 demonstrates how gene expression analysis can be used to find gene variants which are present in mature plants having a desirable phenotype. The presence or absence of such a variant can be used to predict the phenotype of a mature plant, allowing screening of the plants at the seedling stage. Although this example employs *eucalyptus*, the method used herein is also useful in breeding programs for pine and other tree species.

The sequence of a putative density-related gene is used to probe genomic DNA isolated from *Eucalyptus* that vary in density as described in previous examples. Non-transgenically produced *Eucalyptus* hybrids of different wood phenotypes are examined. One hybrid exhibits high wood density and another hybrid exhibits lower wood density. A molecular marker in the 3' portion of the coding region is found which distinguishes a high-density gene variant from a lower density gene variant.

This molecular marker enables tree breeders to assay non-transgenic *Eucalyptus* hybrids for likely density profiles while the trees are still at seedling stage, whereas in the absence of the marker, tree breeders must wait until the trees have grown for multiple years before density at harvest age can be reliably predicted. This enables selective outplanting of the best trees at seedling stage rather than an expensive culling operation and resultant erosion at thinning age. This molecular marker is further useful in the breeding program to determine which parents will give rise to high density outcross progeny.

Molecular markers located in the 3' portion of the coding region of the gene that do not correspond to variants seen more frequently in higher or lower wood density non-transgenic *Eucalyptus* hybrid trees are also useful for fingerprinting different genotypes of *Eucalyptus*, for use in identity-tracking in the breeding program and in plantations.

Example 12

This Example describes microarrays for identifying gene expression differences that contribute to the phenotypic characteristics that are important in commercial wood, namely wood appearance, stiffness, strength, density, fiber dimensions, coarseness, cellulose and lignin content, extractives content and the like.

Woody trees of genera that produce commercially important wood products, in this case *Pinus* and *Eucalyptus*, are felled from various sites and at various times of year for the collection and isolation of RNA from developing xylem, cambium, phloem, leaves, buds, roots, and other tissues. RNA is also isolated from seedlings of the same genera.

All contigs are compared to both the ESTs made from RNA isolated from samples containing developing wood and the sequences of the ESTs made from RNA of various tissues that do not contain developing wood. Contigs containing primarily ESTs that show more hybridization in silico to ESTs made from RNA isolated from samples containing developing wood than to ESTs made from RNA isolated from samples not containing developing wood are determined to correspond to possible novel genes particularly expressed in developing wood. These contigs are then used for BLAST searches against public domain sequences. Those contigs that hybridize in silico with high stringency to no known genes or genes annotated as having only a "hypothetical protein" are selected for the next step. These contigs are considered putative novel genes showing wood-preferred expression.

The longest cDNA clones containing sequences hybridizing to the putative novel genes showing wood-preferred expression are selected from cDNA libraries using techniques well known to those skilled in the art of molecular biology. The cDNAs are sequenced and full-length gene-coding sequences together with untranslated flanking sequences are obtained where possible. Stretches of 45-80 nucleotides (or oligonucleotides) are selected from each of the sequences of putative novel genes showing wood-preferred expression such that each oligonucleotide probe hybridizes at high stringency to only one sequence represented in the ESTs made from RNA isolated from trees or seedlings of the same genus.

Oligomers are then chemically synthesized and placed onto a microarray slide as described in Example 4. Each oligomer corresponds to a particular sequence of a putative novel gene showing wood-preferred expression and to no other gene whose sequence is represented among the ESTs made from RNA isolated from trees or seedlings of the same genus.

Sample preparation and hybridization are carried out as in Example 4. The technique used in this example is more effective than use of a microarray using cDNA probes because the presence of a signal represents significant evidence of the expression of a particular gene, rather than of any of a number of genes that may contain similarities to the cDNA due to conserved functional domains or common evolutionary history. Thus, it is possible to differentiate homologous genes, such as those in the same family, but which may have different functions in phenotype determination.

This hybridization data, gained using the method of Example 6, enables the user to identify which of the putative novel genes actually possesses a pattern of coordinate expression with known genes, a pattern of expression consistent with a particular developmental role, and/or a pattern of expression that suggests that the gene has a promoter that drives expression in a valuable way.

The hybridization data obtained using this method can be used, for example, to identify a putative novel gene that shows an expression pattern particular to the tracheids with the lowest cellulose microfibril angle in developing spring wood (early wood). The promoter of this gene can also be isolated as in Example 8, and operably linked to a gene that has been shown as in Example 9 to be associated with late wood (summer wood). Transgenic pine plants containing this construct are generated using the methods of Example 9, and the early wood of these plants is then shown to display several characteristics of late wood, such as higher microfibril angle, higher density, smaller average lumen size, etc.

Example 13

Example 13 demonstrates the use of a xylem-specific promoter functionally linked to a cell signaling gene for increased plant growth.

Xylem-specific cell signaling gene products are identified via array analyses of different secondary vasculature layers as described in Example 6. Candidate promoters linked to the genes corresponding to these gene products are cloned from pine genomic DNA using, e.g., the BD Clontech Genome-eWalker kit and tested in transgenic tobacco via a reporter assay(s) for cambium specificity/preference. A promoter which overexpresses a gene in xylem can be chosen. The promoter is operably linked to a cell signaling gene and the DNA construct is used to transform a plant. Boosted transcript levels of candidate cell signaling genes, aberrant cell signaling enzyme activity, and modulated growth and development may result in an increase of cell growth thereby increasing xylem-biomass.

Example 14

Example 14 describes the construction strategy and assembly of DNA constructs comprising cell signaling genes.

The DNA construct pWVR202 was used as the base cloning vector for 16 cell signaling gene DNA constructs. The nucleotide sequence of pWVR202 is depicted in TABLE 7 as SEQ ID NO: 584 and graphically shown in FIG. 198. pWVR202 is a modified Ti plasmid comprising a polynucleotide with LB, RB, and nopaline synthase elements. pWVR202 comprises two neomycin phosphotransferase genes, nptII and nptIII, as selectable markers. It also comprises a chimeric *Pinus radiata* superubiquitin promoter and intron (SUBIN) operably linked to a polylinker sequence. The SUBIN promoter was previously described in U.S. Pat. No. 6,380,459 and identified therein as SEQ ID NO: 2. The pWVR202 polylinker comprises a polynucleotide sequence possessing the recognition sites of the restriction endonucleases PstI, NheI, AvrII, ScaI and ClaI.

The pGrowth DNA constructs were assembled by one of two cloning strategies. First, the target gene is excised from the source polynucleotide by a restriction endonuclease causing the resulting polynucleotide fragment to have blunt ends. Such a fragment is cloned into the ScaI restriction endonuclease recognition site. Alternatively, the ends of any polynucleotide fragment can be polished and inserted at the ScaI site. Second, some target polynucleotides were excited by the SpeI restriction endonuclease and inserted into pWVR202 digested by both the AvrII and NheI restriction endonucleases. Those skilled in the art can easily develop other cloning strategies using site-specific endonucleases and other enzymes known in the art. Once complete, the DNA constructs were verified by extensive restriction digests to ensure proper assembly.

Twelve pGrowth DNA constructs comprising cell signaling genes were assembled. TABLE 8 lists the DNA construct, the purported cell signaling gene and the gene SEQ ID NO.

TABLE 8 pGrowth Cell Signaling Gene DNA Constructs

| | DNA Construct | Putative Cell Signaling Gene | SEQ ID NO |
|---|---|---|---|
| 1 | pGrowth1 | Polyphosphoinositide binding protein | 130 |
| 2 | pGrowth2 | Polyphosphoinositide binding protein | 132 |
| 3 | pGrowth3 | Polyphosphoinositide binding protein | 122 |
| 4 | pGrowth11 | Ethylene-responsive elongation factor | 117 |
| 5 | pGrowth21 | G-protein coupled receptor | 150 |
| 6 | pGrowth22 | 14-3-3 protein | 180 |
| 7 | pGrowth23 | 14-3-3 protein | 195 |
| 8 | pGrowth24 | 14-3-3 protein | 192 |
| 9 | pGrowth25 | Synaptobrevin-like | 98 |
| 10 | pGrowth26 | Synaptobrevin-like | 140 |
| 11 | pGrowth27 | Synaptobrevin-like | 155 |
| 12 | pGrowth28 | Synaptobrevin-like | 124 |
| 13 | pGrowth29 | SNF1-related protein kinase | 113 |
| 14 | pGrowth30 | Ethylene Receptor | 152 |
| 15 | pGrowth49 | Synaptobrevin like | 141 |
| 16 | pGrowth51 | Polyphosphoinositide binding protein | 164 |

These DNA constructs are depicted in FIGS. 199-210 and 212-215.

Example 15

Example 15 demonstrates the transformation of *Populus deltoids* with some of the DNA constructs of Example 14.

The DNA constructs described in Example 14 were used to transform *Populus deltoides* stock plant cultures. The DNA constructs used were pGrowth1, pGrowth2, pGrowth3, pGrowth11, pGrowth21, pGrowth22, pGrowth23, pGrowth24, pGrowth25, pGrowth26, pGrowth27, pGrowth28, pGrowth29, and pGrowth30. The DNA construct pWVR8 comprising the gus gene acted as a negative control for subsequent experiments. See Gleave, *Plant Mol. Biol.* 20:1203-27 (1992), Wesley et al., *Plant J.* 27(6):581-90 (2001). Each DNA construct was inoculated into *Agrobacterium* cultures by standard techniques.

*Populus deltoides* stock plant cultures were maintained on DKW medium (see, e.g., Driver and Kuniyuki, *HortScience* 19 (4):507-509 (1984)) with about 2.5 uM zeatin in a growth room with an approximately 16 hour photoperiod. For transformation, petioles were excised aseptically using a sharp scalpel blade from the stock plants, cut into lengths from about 4 mm to about 6 mm, placed on DKW medium with about 1 ug/ml BAP and about 1 ug/ml NAA immediately after harvest, and incubated in a dark growth chamber at about 28° C. for about 24 hours.

*Agrobacterium* cultures were grown to log phase, as indicated by an $OD_{600}$ from about 0.8 to about 1.0 A. Cultures were then pelleted and resuspended in an equal volume of *Agrobacterium* Induction Medium (AIM) containing Woody Plant Medium salts (Lloyd and McCown, *Combined Proceedings of the International Plant Propagators Society* 30:421-427 (1980)), about 5 g/L glucose, about 0.6 g/L MES at about pH 5.8, and about 1 μL of a 100 mM stock solution of acetosyringone per ml of AIM. The *Agrobacterium* pellet was resuspended by vortexing. Bacterial cells were incubated for an about an hour at about 28° C. in an environmental chamber while being shakien at about 100 rpm.

Subsequently, *P. deltoides* explants were exposed to the *Agrobacterium* mixture for approximately 15 minutes. The explants were then lightly blotted on sterile paper towels, replaced onto the same plant medium and cultured in the dark at about 18° C. to about 20° C. After a three-day co-cultivation period, the explants were transferred to DKW medium in which the NAA concentration was reduced to about 0.1 ug/ml and to which was added about 400 mg/L timentin.

After approximately 4 days on eradication medium, explants were transferred to small magenta boxes containing the same medium supplemented with timentin (400 mg/L) as well as the selection agent geneticin (50 mg/L). Explants were transferred every two weeks to fresh selection medium. Calli that grow in the presence of the selection medium were isolated and sub-cultured to fresh selection medium every three weeks. Calli were observed for the production of adventitious shoots.

Adventitious shoots were normally observed within two months from the initiation of transformation. These shoot clusters were transferred to DKW medium to which no NAA was added, and in which the BAP concentration was reduced to 0.5 ug.ml. This medium was designed for shoot elongation to occur over a period of about 14 weeks. Subsequently, elongated shoots were excised and transferred to BTM medium (see Chalupa, *Communicationes Instituti Forestalis Checosloveniae* 13:7-39, (1983)) at about pH5.8 and containing about 20 g/l sucrose and about 5 g/l activated charcoal. The complete BTM-1 formula is set forth in TABLE 9. This medium facilitates the development of roots.

TABLE 9

Exemplary Rooting Medium for *Populus deltoides*

| BTM-1 Media Components | mg/L |
|---|---|
| NH₄NO₃ | 412 |
| KNO₃ | 475 |
| Ca(NO₃)₂•4H₂O | 640 |
| CaCl₂•2H₂O | 440* |
| MgSO₄•7H₂O | 370 |
| KH₂PO₄ | 170 |
| MnSO₄•H₂O | 2.3 |
| ZnSO₄•7H₂O | 8.6 |
| CuSO₄•5H₂O | 0.25 |
| CoCl₂•6H₂O | 0.02 |
| KI | 0.15 |
| H₃BO₃ | 6.2 |

TABLE 9-continued

Exemplary Rooting Medium for *Populus deltoides*

| BTM-1 Media Components | mg/L |
|---|---|
| Na₂MoO₄•2H₂O | 0.25 |
| FeSO₄•7H₂O | 27.8 |
| Na₂EDTA•2H₂O | 37.3 |
| Myo-inositol | 100 |
| Nicotinic acid | 0.5 |
| Pyridoxine HCl | 0.5 |
| Thiamine HCl | 1 |
| Glycine | 2 |
| Sucrose | 20000 |
| Activated Carbon | 5000 |

After development of roots, which typically occurs in about 4 weeks, transformants were propagated in a greenhouse by rooted cutting methods or in vitro through auxiliary shoot induction. In the later case, transformants were grown for about four weeks on DKW medium containing about 11.4 µM zeatin. Subsequently, the multiplied shoots from each transformant line were separated and transferred to root induction medium (each plant of a line is a ramet). Rooted plants were transferred to soil for evaluation of growth in glasshouse and field conditions.

Example 16

Example 16 demonstrates the modulation of adventitious shoots in the transformed plants of Example 15.

Approximately 100 explants of *P. deltoides* were transformed by the method of Example 15 with each of the DNA constructs described in Example 14 (except pGrowth1, pGrowth2, pGrowth3, pGrowth29, pGrowth49 and pGrowth51). A number of explants transformed with pGrowth22, pGrowth25 and pGrowth30 were found to provide shoots of a size that were already transferable to rooting medium at only 12 weeks after transformation. TABLE 10 demonstrates the regenerative capability of the transformants.

TABLE 10

Exemplary Growth Data for Cell Signal Gene Transformants

| DNA Construct | No. of Petiole Explants | No. of Calli | Percent Efficiency of Calli From Total Petioles | No. Regenerating from Callus on Selection | Percent of Calli Regenerating from Harvested Calli | No. of Shoot Lines | Percent of Shoot Lines Collected from Haversted Calli |
|---|---|---|---|---|---|---|---|
| pGrowth11 | 96 | 38 | 39.58 | 7 | 18.42 | 0 | 0.00 |
| pGrowth21 | 98 | 83 | 84.69 | 7 | 8.43 | 0 | 0.00 |
| pGrowth22 | 100 | 54 | 54.00 | 3 | 5.56 | 1 | 1.85 |
| pGrowth23 | 96 | 50 | 52.08 | 1 | 2.00 | 0 | 0.00 |
| pGrowth24 | 95 | 31 | 32.63 | 3 | 9.68 | 0 | 0.00 |
| pGrowth25 | 75 | 79 | 105.33 | 3 | 3.80 | 3 | 3.80 |
| pGrowth26 | 97 | 62 | 63.92 | 0 | 0.00 | 0 | 0.00 |
| pGrowth27 | 100 | 98 | 98.00 | 6 | 6.12 | 0 | 0.00 |
| pGrowth28 | 98 | 104 | 106.12 | 8 | 7.69 | 0 | 0.00 |
| pGrowth30 | 100 | 69 | 69.00 | 1 | 1.45 | 1 | 1.45 |
| pWVR8 | 100 | 56 | 56.00 | 0 | 0.00 | 0 | 0.00 |

Briefly, calli produced on petiole explants are observed regularly. As shoots formed, they were transferred to shoot elongation medium. Sufficiently healthy and elongated shoot lines were transferred to rooting medium as they became ready. Only transformants comprising pGrowth22, pGrowth25 and pGrowth30 were found to possess a phenotype characterized by rapid regeneration.

At 3 months, neither the other transformants nor the control transformant had produced shoot lines that were ready to be collected for rooting. Cultures of the pGrowth22, pGrowth25 and pGrowth30 transformants, however, were ready to be moved to rooting medium. FIG. 211 shows the percent of shoot lines from each transformant which were ready to be placed in rooting medium. TABLE 10 demonstrates that the regeneration-enhancing effect of the putative cell signaling genes was not due to increased transformation efficiency, although pGrowth25 appears to have raised transformation efficiency relative to the control and the other plasmids.

Likewise, TABLE 11 shows the subsequent growth of the transformants. First, TABLE 11 demonstrates the regeneration of the other transformants and control plants within 5 months. Second, TABLE 11 illustrates that the characteristic of the pGrowth22, pGrowth25 and pGrowth30 transformants was, in fact, accelerated regeneration and not an increase in the total number of shoot lines produced.

TABLE 11

Exemplary Growth Data for Cell Signal Gene Transformants

| | 3 Months | | 4 Months | | 5 Months | |
|---|---|---|---|---|---|---|
| DNA Construct | No. of Shoot Lines | Percent of Lines from Harvested Calli | No. of Shoot Lines | Percent of Lines from Harvested Calli | No. of Shoot Lines | Percent of Lines from Harvested Calli |
| pGrowth11 | 0 | 0.00 | 0 | 0.00 | 4 | 10.53 |
| pGrowth21 | 0 | 0.00 | 0 | 0.00 | 11 | 13.25 |
| pGrowth22 | 1 | 1.85 | 1 | 1.85 | 6 | 11.11 |
| pGrowth23 | 0 | 0.00 | 0 | 0.00 | 1 | 2.00 |
| pGrowth24 | 0 | 0.00 | 0 | 0.00 | 2 | 6.45 |
| pGrowth25 | 3 | 3.80 | 3 | 3.80 | 4 | 50.6 |
| pGrowth26 | 0 | 0.00 | 1 | 1.61 | 3 | 4.84 |
| pGrowth27 | 0 | 0.00 | 7 | 7.14 | 10 | 10.20 |
| pGrowth28 | 0 | 0.00 | 5 | 4.81 | 5 | 4.81 |
| pGrowth30 | 1 | 1.45 | 1 | 1.45 | 5 | 7.25 |
| pWVR8 | 0 | 0.00 | 0 | 0.00 | 1 | 1.79 |

*P. deltoides* is a model species representing a variety of commercially important angiosperm species useful for the testing of the effect of cell signaling genes and gene products on plant growth and development. Regeneration of plantlets from cottonwood callus cultures produced by transformation is a rate-limiting step for the establishment of plants in outdoor field tests. In this example, the control plant did not produce any shoot lines ready for transfer to rooting medium until 5 months after transformation. An acceleration of two months could, in certain seasons, significantly advance the establishment of transgenic plants. In certain seasons, up to a year of growth can be saved using the pGrowth22, pGrowth25 and pGrowth30 transformants.

Example 17

Example 17 demonstrated the qualitative and quantitative modulation of plant leaves in the transformed plants of Example 15.

*P. deltoids* plants were transformed with the DNA construct pGrowth24 by the method of Example 15. The pGrowth24 DNA construct ectopically overexpresses a putative 14-3-3 protein disclosed as SEQ ID NO: 192. The cloning strategy and assembly of pGrowth24 is described in Example 14. Negative control plants were transformed with the GUS expressing DNA construct pWVR8 described in Gleave, *Plant Mol. Biol.* 20:1203-27 (1992) and Wesley et al., *Plant J.* 27(6):581-90 (2001).

Upon regeneration, the pGrowth24-transformed plants presented an aberrant phenotype as compared to the negative control plants. Specifically, the transformants presented particularly narrow leaves in tissue culture. Ramlets generated in tissue culture continued to present this narrow leaf phenotype. After the ramlets were transferred from tissue culture to hormone-free BTM rooting medium, the narrow leaf phenotype persisted.

The transformants' leaves are exceptionally narrow as compared to the negative control. However, the length of the transformants' leaves were qualitatively similar to those of the negative control plants. Lastly, the transformants presented a qualitative increase in the number of leaves per plant as compared to a negative control plant of the same height (i.e., an increase of leaves per unit plant height).

Accordingly, by qualitatively and quantitatively modulating leaf surface area, the DNA constructs may alter the capacity of a plant for photosynthesis.

Example 18

Example 18 demonstrates the qualitative and quantitative modulation of stem growth and development in the transformed plants of Example 15.

*P. deltoids* plants were transformed with the DNA construct pGrowth25 by the method of Example 15. The pGrowth25 DNA construct ectopically overexpresses a putative synaptobrevin-like protein disclosed as SEQ ID NO: 98. The cloning strategy and assembly of pGrowth25 is described in Example 14. Negative control plants were transformed with the GUS expressing DNA construct pWVR8 described in Gleave, *Plant Mol. Biol.* 20:1203-27 (1992) and Wesley et al., *Plant J.* 27(6):581-90 (2001).

The transformants' presented unusually rapid regeneration as compared to the negative control plants. In addition, the transformants presented a qualitative and quantitative difference in stem growth. First, the transformants appeared to growth faster and longer compared to the negative control plants. Second, transformants presented quantitatively longer internodes than the negative control plants.

The modulation of internode length is commercially significant for the commercial forestry industry. In woody plants, stem nodes subtend potential branch. Branches, themselves, form a locus for undesirable traits such as knot formation and the deposition of compression wood. Both traits reduce the utility of the woody plant for pulp and solid wood products.

Accordingly, by qualitatively and quantitatively modulating stem growth, the DNA constructs may alter the utility of the plant for the commercial forestry industry.

Example 19

Example 19 demonstrates the qualitative modulation of stem growth and development in the transformed plants of Example 15.

*P. deltoids* plants were transformed with the DNA construct pGrowth27 by the method of Example 15. The pGrowth27 DNA construct ectopically overexpresses a putative synaptobrevin-like protein disclosed as SEQ ID NO: 155. The cloning strategy and assembly of pGrowth25 is described in Example 14. Negative control plants were transformed with the GUS expressing DNA construct pWVR8 described in Gleave, *Plant Mol. Biol.* 20:1203-27 (1992) and Wesley et al., *Plant J.* 27(6):581-90 (2001).

The transformants presented longitudinal invaginations of the stem. These invaginations are characterized as striations in the stem longitudinal architecture. As such, the transformants possessed stems which appeared either "corrugated" or possessing callus under the epidermis. From these observations, it appeared that the rate of cell division in the radial and/or tangential plane in the stem was exceeding the rate of tangential cell expansion. As the transformants grew, the stem striations became more pronounced. Likewise, the growth remained stem specific in all but one transformant. In that case, the plant leaves were unusually rounded convoluted across the face of the leaf. It is thought that both phenotypic characteristics result from an increase in cell division.

Synaptobrevins/vesicle-associated membrane proteins (VAMPs) together with syntaxins and a synaptosome-associated protein of 25 kDa (SNAP-25) are the main components of a protein complex involved in the docking and/or fusion of synaptic vesicles with the presynaptic membrane in *Saccharomyces cerevisiae*. It appears that the gene is conserved among eukaryotes, but its function in higher plants is as yet unknown. These observations represent the first description of a phenotype in plants produced by these genes.

To the commercial forestry industry, the striation phenotype has significant potential utility. It is believed that the striations are an indication of greater cell division rates in diameter growth. Striations are commonly seen in cottonwood on older, more mature stems. In contrast, newly emerging, succulent stems, such as those present in tissue culture, are smooth and cylindrical. It is believed that new, succulent shoots may be smooth for up to 3 feet from their distal/apical end to the point where striations begin to form. Striations seem to be associated with stems of larger diameter, for instance ones that are greater than 1 inch in circumference.

Moreover, this phenotype may indicate a quantitative increase in the density of stems and branches. This increased density and longitudinal thickening can provide additional support for the plant. In woody plants, species presenting longitudinal striations are more likely to form in waterlogged soils. It is thought that the increased striation phenotype described here is indicative of transformants adapted for soils in which less stable trees can topple.

Example 20

Example 20 demonstrated the effect of cell signaling genes on growth in the transformed plants of Example 15.

*P. deltoids* plants were transformed with the DNA constructs pGrowth2, pGrowth3, pGrowth11, pGrowth21, pGrowth22, pGrowth23, pGrowth24, pGrowth25, pGrowth26, pGrowth27, pGrowth28 and pGrowth30 by the method of Example 15. Negative control plants were transformed with the GUS expressing DNA construct pWVR8 described in Gleave, *Plant Mol. Biol.* 20:1203-27 (1992) and Wesley et al., *Plant J.* 27(6):581-90 (2001).

Rooted plants made by the method described in Example 15 were transferred to a mist house for between 10 days and 2 weeks to facilitate acclamation. Misting conditions varied depending on outside environmental conditions. Plants were then grown in standard greenhouse conditions for 2.5 to 3 months before being moved to outdoor conditions for between 7 to 10 days for hardening.

Four ramets for each line and the control were then planted in a field trial in a randomized block design. After 7 months of growth, plant height and diameter were measured to calculate the volume or biomass of the trees. Height was measured between the root collar and the terminal bud, while diameter was taken at breast height (4.5 feet) (Diameter at Breast Height=DBH). The volume index was calculated by multiplying the square of the DBH by the height. All subsequent growth measurements are a comparison of the volume index calculated as described above.

Plants transformed with pGrowth2 or pGrowth3 were measured after 14 months of growth, while plants transformed with pGrowth11, pGrowth21, pGrowth22, pGrowth23, pGrowth24, pGrowth25, pGrowth26, pGrowth27, pGrowth28 and pGrowth30 were measured after 18 months of growth. For example, after 18 months of growth plants transformed with pGrowth11, pGrowth21, pGrowth24, pGrowth25, pGrowth26, pGrowth27, and pGrowth30 did not demonstrate overall growth increases over the GUS control plants, but did generate rapidly growing lines with volume growth increases exceeding 50%. These lines with growth increases exceeding 50% result in their being a shift in the population and thus an increase of the volume in the top elite plants within that population compared to the top elite plants of the control. It was observed that one out of 8 lines (13%) of construct pGrowth 11 had growth increases exceeding 50%; the growth increase of this line was 100%. Four out of 15 lines (27%) of construct pGrowth21 had growth increases exceeding 50%; growth increases of these lines were 96%, 84%, 79%, and 54%. One out of 9 lines (11%) of construct pGrowth24 had growth increases exceeding 50%; the growth increase of this line was 55%. Two out of 27 lines (7%) of construct pGrowth25 had growth increases exceeding 50%; growth increases of these lines were 110% and 94%. One out of 8 lines (13%) of construct pGrowth26 had growth increases exceeding 50%; the growth increase of this line was 75%. Two out of 28 lines (7%) of construct pGrowth27 had growth increases exceeding 50%; growth increases of these lines were 98% and 88%. One out of 13 lines (8%) of construct pGrowth30 had growth increases exceeding 50%; the growth increase of this line was 117%. Table 12 summarises the results for the putative cell signaling genes that were transformed into *P. deltoids* plants.

TABLE 12

Exemplry growth data for cell signaling gene in *P. deltoids* transformants

| DNA Construct | SEQ ID NO | plants displaying growth increases of >50% | % of plants with growth increases of >50% | % growth increase compared with control |
|---|---|---|---|---|
| pGrowth2 | 132 | — | | |
| pGrowth3 | 122 | — | | |
| pGrowth11 | 117 | yes | 13% | 100% |
| pGrowth21 | 150 | yes | 27% | 54%-96% |
| pGrowth22 | 180 | — | | |
| pGrowth23 | 195 | — | | |
| pGrowth24 | 192 | yes | 11% | 55% |
| pGrowth25 | 98 | yes | 7% | 94%-110% |
| pGrowth26 | 140 | yes | 13% | 75% |
| pGrowth27 | 155 | yes | 7% | 88%-98% |
| pGrowth28 | 124 | — | | |
| pGrowth30 | 152 | yes | 8% | 117% |

Example 21

Example 21 demonstrates the modulation of plant growth and development by the modulation of the programmed cell death (PCD) signaling cascade.

*P. deltoids* plants were transformed with the DNA constructs pGrowth1 and pGrowth2 by the method of Example 15. The pGrowth1 DNA construct ectopically overexpresses a putative polyphosphoinositide binding protein disclosed as SEQ ID NO: 130. The cloning strategy and assembly of pGrowth1 is described in Example 14. The pGrowth2 DNA construct ectopically overexpresses a putative polyphosphoinositide binding protein SSH2P disclosed as SEQ ID NO: 132. The cloning strategy and assembly of pGrowth2 is described in Example 14. Negative control plants were transformed with the GUS expressing DNA construct pWVR8 described in Gleave, *Plant Mol. Biol.* 20:1203-27 (1992) and Wesley et al., *Plant J.* 27(6):581-90 (2001).

Transformants of each DNA construct presented, in tissue culture, shoots with a patterned necrosis occurring in and immediately surrounding the vasculature of fully expanded leaf blades. It is thought that the necrosis resulted from a PCD signaling cascade.

PCD has been the subject of considerable investigation by many researchers, and genes that are involved in PCD are claimed in multiple patent applications and patents, including U.S. Pat. No. 6,451,604.

The transformants appear to initiate a PCD cascade specifically in the leaf blade vasculature and surrounding cells. These two genes are normally expressed in a xylem-preferred manner, as shown by the method of Example 11. It is thought that the putative polyphosphoinositide binding protein functions in the PCD signaling pathway that normally occurs during xylem development or leaf abscission. However, the transformants express the protein here ectopically. The ectopic activity appeared to be predominantly on older, fully expanded leaves. Ramets of most of the translines perpetuated this phenotype through propagation, suggesting that the phenotype observed is not a tissue-culture effect.

To the forestry industry, modulation of the PCD signaling cascade has significant commercial importance. First, in some hardwood species, modulation of the PCD can be used to effect earlier PCD in developing xylem through the use of tissue specific promoters. This, in turn, can result in smaller xylem cells, denser wood, and perhaps more compact overall habit.

Likewise, PCD can be down-regulated through the use of antisense or RNAi DNA constructs with tissue-specific promoters. It is thought that down-regulation of PCD in xylem can result in larger xylem cells and greater wood volume. Similarly, down-regulation of PCD in leaf tissue can result in delayed leaf abscission, thereby extending the duration of leaf photosynthesis and resulting in enhanced overall growth of the plant.

Moreover, it is thought the phenotypic patterned necrosis occurs because the cell signaling gene products of pGrowth1 and pGrowth2 require the presence of additional gene products to initiate or sustain the PCD signaling cascade. It may be the additional factors are present only in the vasculature of maturing leaves, i.e. not in leaf primordia or elsewhere in the leaf blade.

Example 22

Example 22 demonstrates the transformation of *Eucalyptus grandis×Eucalyptus europhylla* with the DNA constructs of Example 14 and the growth and propagation of transgenic *E. grandis×E. europhylla* plants.

pGrowth22 and pGrowth27 as described in Example 14, were used to transform clonal *E. grandis×E. europhylla* leaf explants. The leaf explants were transformed according to the protocol described in International patent publication WO00/12715, except where noted below. In brief, dissected leaf explants were inoculated with *Agrobacterium* comprising the DNA constructs pGrowth22 or pGrowth27. Inoculated explants were co-cultured for two weeks in diffuse light and selected on agar supplemented with 250 mg/L kanamycin and 250 mg/L timentin (omitting NAA from the transformation media). Leaf explants were then cultured for two weeks on on agar supplemented with 100 mg/L kanamycin and 250 mg/L timentin. The leaf explants were cultured for another two weeks on on agar supplemented with 150 mg/L kanamycin and 250 mg/L timentin. Thereafter and until healthy single shoots were collected, the leaf explants were transferred monthly to fresh media containing 150 mg/L kanamycin and 250 mg/L timentin.

Single shoots were placed in elongation media in order to proliferate the putative transgenic tissue. The alongation media consists of Murashige and Skoog salts (MS) supplemented with 1 microM 6-benzylaminopurine (BAP), 20 g/L sucrose and 7 g/L agar. PCR analysis of the explant tissue was conducted after approximately 200 mg of tissue is grown and collected. Both the promoter and gene sequences were verified using PuRe Taq Ready-To-Go™ PCR beads (Amersham Biosciences, Piscataway, N.J.). PCR positive explants were then maintained as sock cultures through proliferation on elongation media supplemented with 150 mg/L kanamycin and 250 mg/L timentin.

Transgenic *E. grandis×E. europhylla* plants were propagated from these stock cultures. Where necessary, shoots were transferred monthly to fresh media. Single shoots were placed onto elongation media and maintained until reaching approximately 2-3 cm tall. Thereafter, single shots were placed into conventional rooting medium. After 10 days, the transformed plants were transferred to a green house with appropriate climate. A skilled artisan would recognize that many different culture media and intervals may be suited to regenerating plants of the instant invention. Using an appropriate humidity regime and fungicides to control fungal growth, plants were then grown in standard greenhouse conditions for 2.5 to 3 months before being moved to outdoor conditions for between 7 to 10 days for hardening.

Example 23

Example 23 demonstrated the effect of cell signaling genes on growth in the transformed plants of Example 22.

Eight ramets for each line transformed in Example 22 and an untransformed control were then planted in a field trial in a randomized block design. After 7 months of growth, plant height and diameter were measured to calculate the volume or biomass of the trees as described in Example 20. All subsequent growth measurements are a comparison of the volume index calculated as described above.

Plants transformed with pGrowth22 or pGrowth27 resulted in significant volume growth increases compared to the control untransformed plants. Average volume growth increases of 47% and 161% respectively have been recorded.

Six out of 14 lines (43%) of pGrowth22 lines have volume growth gains of at least 50% compared to the untransformed controls. The top 3 lines have volume growth gains of 249%, 214%, and 107% or a mean increase of 190%. Eleven out of 15 lines (73%) of pGrowth27 lines have volume growth gains of at least 50% compared to the untransformed controls. The top 3 lines have volume growth gains of 455%, 337%, and 306% or a mean increase of 366%. Table 13 summarises the results for the putative cell signaling genes that were transformed into *E. grandis×E. europhylla* plants.

TABLE 13

Exemplry growth data for cell signaling genes in *E. grandis* × *E. europhylla* transformants

| DNA Construct | SEQ ID NO | plants displaying growth increases of greater than 50% | % of plants with growth increases >50% | Mean % growth of top three transformants compared with control |
|---|---|---|---|---|
| pGrowth22 | 180 | yes | 45% | 190% |
| pGrowth27 | 155 | yes | 73% | 366% |

Example 24

Example 24 demonstrates the transformation of *Pinus taeda* with the DNA constructs of Example 14 and the growth and propagation of transgenic *P. taeda* plants pGrowth1, pGrowth2, pGrowth3, pGrowth11, pGrowth21, pGrowth23, pGrowth25 and pGrowth30 as described in Example 14, were used to transform clonal *P. taeda*. Specified clones of elite selected families of loblolly pine (*Pinus taeda*), was initiated as embryogenic cell lines from zygotic embryos of individual immature megagametophytes using the procedures described in U.S. Pat. No. 5,856,191, and maintained using the procedures described in U.S. Pat. No. 5,506,136.

After one to three months of culture on maintenance medium, the tissue cultures were cryopreserved, stored for periods of up to several years, and retrieved using the methods of U.S. Pat. No. 6,682,931. Those skilled in the art of plant tissue culture will recognize that other cryopreservation and recovery protocols would be applicable to the present method and that the detail in this example may not be construed to limit the application of the method.

Uniform suspension cultures from each of the genetically different tissue culture lines were established by inoculating a 250 ml Nephelo sidearm flask (Kontes Chemistry and Life Sciences Products) with 1 g of tissue each according to the method of U.S. Pat. No. 5,491,090. The flasks containing the cells in liquid medium were placed on a gyrotory shaker at 100 rpm in a dark culture room at a temperature of 23° C.±2° C. One week later, the liquid in each flask was brought to 35 ml by pouring 15 ml fresh medium into the culture flask and swirling to evenly distribute the cells. Cell growth was measured in the sidearm by decanting cells and medium into the sidearm portion of the flasks, allowing the cells to settle for 30 minutes and then measuring the settled cell volume (SCV). When the SCV was greater than or equal to half the maximal SCV (50% of the volume of the flask was occupied by plant cells), each culture was transferred to a 500 ml sidearm flask containing a total of 80 ml cells and medium and the transferred culture was maintained under the same conditions.

To prepare for gene transfer, polyester membrane supports were sterilized by autoclaving and placed in separate sterile Buchner funnels, and for each of six replicate plates per cell line, one to three milliliters of pine embryogenic suspension was pipetted onto each support such that the embryogenic tissue was evenly distributed. The liquid medium was suctioned from the tissues and each support bearing the embryogenic tissue was placed on gelled preparation medium for *Agrobacterium* inoculation according to the methods described in U.S. Patent Publication No. 20020100083. Specifically, the constructs pGrowth1, pGrowth2, pGrowth3, pGrowth 11, pGrowth21, pGrowth23, pGrowth25 and pGrowth30 as described in Example 14, were each introduced into different isolates *Agrobacterium tumefaciens* by techniques well known to those skilled in the art, and virulence was induced with administration of acetosyringone by commonly used techniques whereupon each of the induced *Agrobacterium* isolates was co-mingled with separate replicates of the plant material according to the methods described in U.S. Patent Publication No. 20020100083. The cells were co-cultivated in the dark at 22°±2° C. for approximately 72 hours.

Following co-cultivation, *Agrobacterium* was eradicated from the cultures according to the methods described in U.S. Patent Publication No. 20020100083. Cells borne on polyester membrane supports were then transferred onto fresh selection media at intervals of 2 weeks. Active growth on the selection medium occurred in a number of isolated sectors on many of the petri dishes. Such active growth in the presence of selection agent was normally an indication that the growing tissues have integrated the selection gene into their chromosomes and are stably transformed. These areas of active growth are treated as independent transformation events and were henceforth referred to as putative transgenic sublines. The putatively transgenic embryogenic tissue was multiplied by transferring growing transgenic sectors to fresh semi-solid maintenance medium supplemented with the respective selection agent.

Putatively transformed sublines, after reaching approximately 2 g, were chosen for polymerase chain reaction (PCR) amplification for verification of the presence of transgenes using standard techniques. Lines that had been verified by PCR were selected for testing alongside lines transformed with the GUS control construct pWVR31.

Germinable embryos were produced from each of the selected lines verified as transformed by PCR, as follows. After the cell masses cultured on selection medium have proliferated to at least one gram, each culture was separately resuspended in liquid medium. When the cell suspensions were brought to uniform (half-maximal) SCV, equivalent amounts of suspension culture cells were pipetted onto sterile membrane supports for placement on development/maturation medium as described in U.S. Pat. No. 5,506,136 to develop high quality harvestable stage 3 (cotyledonary) embryos. Dishes were incubated in a dark growth chamber at 23±2° C. The membrane supports were transferred to new petri dishes containing fresh medium every 3 weeks. At week 9, stage 3 (cotyledonary) embryos were visually analyzed for germination quality and harvested onto fabric supports on medium as described in U.S. Pat. No. 5,506,136, and incubated for about four weeks in the dark at a temperature of 4° C.±2° C. Next, embryos on their fabric supports were incubated above water in sealed containers for about three weeks in the dark at a temperature of 25° C.±2° C. Following the above two treatments, embryos on their fabric supports were transferred to medium germination medium and incubated for about three days in the dark at a temperature of 25° C.±2°

C. Embryos were then removed from their fabric supports and placed onto the surface of fresh germination medium. Germination was conducted in the light at a temperature of 25° C.±2° C. Germination plates were examined weekly, over a period of about four weeks, and germinating embryos were transferred to MAGENTA® boxes containing 100 ml of germination medium for conversion to plantlets. MAGENTA® boxes containing developing plantlets were incubated in the light at 25° C.±2° C. for about eight to twelve weeks.

When the plantlets formed epicotyls (newly formed shoots of approximately two to four cm), they were transferred to containers filled with a potting mix [2:1:2 peat:perlite:vermiculite, containing 602 g/m³ OSMOCOTE fertilizer (18-6-12), 340 g/m³ dolomitic lime and 78 g/m³ MICRO-MAX micronutrient mixture (Sierra Chemical Co.)]. The plantlets were grown in a shaded greenhouse and misted infrequently for a period of about two weeks. They were removed from mist for acclimatization in the greenhouse for 5 to 6 months. Plantlets were then transferred to outdoor conditions for 7 to 10 days final acclimatization before field planting.

Once transformed and propagated, a skilled artisan would also recognize the accelerated reproduction of *Pinus* plants can occur by grafting of the plantlets. See, e.g., Mergen, F. (1954) Rooting and grafting of slash pine (*Pinus elliottii* Engel.) for application in forest genetics. Ph.D. dissertation, Yale University, New Haven, Conn.; and Ahlgren, C. E. (1967) A relationship between scion, bud origin and growth of white pine grafts. *Minnesota Forestry Notes* 180. University of Minnesota, St. Paul. 2 p.

Example 25

Example 25 demonstrated the effect of cell signaling genes on growth in the transformed plants of Example 24.

Four ramets for each line transformed in Example 24 and the GUS control (pWVR31) plants were then planted in a field trial in a randomized block design. After 15 months of growth, plant height and diameter were measured to calculate the volume or biomass of the trees. Height was measured between the root collar and the terminal bud, while diameter was measured at the root collar. The volume index was calculated by multiplying the square of the root collar diameter by the height. All subsequent growth measurements are a comparison of the volume index calculated as described above.

After 15 months of growth, plants transformed with pGrowth1, pGrowth3, pGrowth11, pGrowth21, and pGrowth30 had growth increases of 34%, 8%, 28%, 10%, and 28% respectively when compared to the mean growth of the GUS controls. Two out of 8 lines (25%) of construct pGrowth1 had growth increases exceeding 50%; growth increases of these two lines were 103% and 70%. One out of 10 lines (10%) of construct pGrowth3 had growth increases exceeding 50%; the growth increase of this line was 136%. Two out of 8 lines (25%) of construct pGrowth11 had growth increases exceeding 50%; growth increases of these two lines were 106% and 81%. One out of 8 lines (13%) of construct pGrowth21 had growth increases exceeding 50%; the growth increase of this line was 109%. Two out of 9 lines (22%) of construct pGrowth30 had growth increases exceeding 50%; the growth increases of these two lines were 116% and 71%. Table 14 summarises the results for the putative cell signaling genes that were transformed into *P. taeda* plants.

TABLE 14

Exemplry growth data for cell signaling genes in *P. taeda* transformants

| DNA Construct | SEQ ID NO | plants with mean growth increases when compared to controls and with increases of >50% | Mean % growth increase when compared with control | % of plants with growth increases >50% | % growth increase compared with control |
|---|---|---|---|---|---|
| pGrowth1 | 130 | yes | 35% | 25% | 70%-103% |
| pGrowth2 | 132 | — | | | |
| pGrowth3 | 122 | yes | 8% | 10% | 136% |
| pGrowth11 | 117 | yes | 28% | 25% | 81%-106% |
| pGrowth21 | 150 | yes | 10% | 13% | 109% |
| pGrowth23 | 195 | — | | | |
| pGrowth25 | 98 | — | | | |
| pGrowth30 | 152 | yes | 28% | 22% | 71%-116% |

A summary of results in examples 16, 17, 18, 20, 21, 23, and 25 are presented in table 15.

* * *

While the invention is described with reference to exemplary embodiments, it will be understood by those skilled in the art that various changes may be made and equivalents may be substituted for elements thereof without departing from the scope of the invention. In addition, many modifications may be made to adapt a particular situation or material to the teachings of the invention without departing from the essential scope thereof. Therefore, it is intended that the invention not be limited to the particular embodiment disclosed as the best mode contemplated for carrying out this invention. All references and publications cited herein are incorporated by reference in their entireties.

TABLE 1

Cell Signaling Genes and Corresponding Gene Products

| SEQ ID NO | Target | ConsID | Species | Protein SEQ ID NO | ORF Start | ORF Stop | SEQ ID NO | OligoID |
|---|---|---|---|---|---|---|---|---|
| 1 | 14-3-3 protein | eucalyptusSpp_000217 | E. grandis | 198 | 84 | 845 | 395 | Euc_000217_O_1 |
| 2 | 14-3-3 protein | eucalyptusSpp_000345 | E. grandis | 199 | 293 | 1081 | 396 | Euc_000345_O_3 |
| 3 | 14-3-3 protein | eucalyptusSpp_000402 | E. grandis | 200 | 504 | 1298 | 397 | Euc_000402_O_1 |
| 4 | 14-3-3 protein | eucalyptusSpp_000989 | E. grandis | 201 | 128 | 916 | 398 | Euc_000989_O_5 |
| 5 | Indole-3-acetaldehyde reductase | eucalyptusSpp_001121 | E. grandis | 202 | 6 | 1523 | 399 | Euc_001121_O_4 |
| 6 | Indole-3-acetaldehyde reductase | eucalyptusSpp_001122 | E. grandis | 203 | 15 | 1532 | 400 | Euc_001122_O_2 |
| 7 | Indole-3-acetaldehyde reductase | eucalyptusSpp_001123 | E. grandis | 204 | 18 | 1550 | 401 | Euc_001123_O_2 |
| 8 | RAB7 | eucalyptusSpp_001357 | E. grandis | 205 | 144 | 767 | 402 | Euc_001357_O_2 |
| 9 | 14-3-3 protein | eucalyptusSpp_001976 | E. grandis | 206 | 127 | 879 | 403 | Euc_001976_O_2 |
| 10 | 14-3-3 protein | eucalyptusSpp_002470 | E. grandis | 207 | 1293 | 262 | 404 | Euc_002470_O_1 |
| 11 | 14-3-3 protein | eucalyptusSpp_002585 | E. grandis | 208 | 102 | 893 | 405 | Euc_002585_O_1 |
| 12 | MAP kinase kinase | eucalyptusSpp_003164 | E. grandis | 209 | 105 | 1175 | 406 | Euc_003164_O_3 |
| 13 | RAB11G | eucalyptusSpp_003661 | E. grandis | 210 | 833 | 215 | 407 | Euc_003661_O_3 |
| 14 | RAB11G | eucalyptusSpp_003664 | E. grandis | 211 | 167 | 823 | 408 | Euc_003664_O_5 |
| 15 | Indole-3-acetonitrilase | eucalyptusSpp_003672 | E. grandis | 212 | 177 | 1241 | 409 | Euc_003672_O_1 |
| 16 | F-box family | eucalyptusSpp_003901 | E. grandis | 213 | 613 | 2355 | 410 | Euc_003901_O_2 |
| 17 | Ethylene receptor | eucalyptusSpp_003961 | E. grandis | 214 | 263 | 2500 | 411 | Euc_003961_O_2 |
| 18 | RAB7 | eucalyptusSpp_004008 | E. grandis | 215 | 142 | 762 | 412 | Euc_004008_O_2 |
| 19 | RAS-like GTP-binding protein | eucalyptusSpp_004124 | E. grandis | 216 | 89 | 745 | 413 | Euc_004124_O_1 |
| 20 | RAS-like GTP-binding protein | eucalyptusSpp_004275 | E. grandis | 217 | 145 | 795 | 414 | Euc_004275_O_2 |
| 21 | RAS-like GTP-binding protein | eucalyptusSpp_004355 | E. grandis | 218 | 911 | 218 | 415 | Euc_004355_O_3 |
| 22 | RAS-like GTP-binding protein | eucalyptusSpp_004433 | E. grandis | 219 | 245 | 922 | 416 | Euc_004433_O_3 |
| 23 | MAP kinase | eucalyptusSpp_004776 | E. grandis | 220 | 89 | 1210 | 417 | Euc_004776_O_2 |
| 24 | MAP kinase | eucalyptusSpp_004796 | E. grandis | 221 | 394 | 1512 | 418 | Euc_004796_O_1 |
| 25 | F-box family | eucalyptusSpp_004824 | E. grandis | 222 | 935 | 2653 | 419 | Euc_004824_O_2 |
| 26 | GAI giberellic acid insensitive | eucalyptusSpp_004908 | E. grandis | 223 | 297 | 2183 | 420 | Euc_004908_O_4 |
| 27 | F-box family | eucalyptusSpp_005075 | E. grandis | 224 | 215 | 2146 | 421 | Euc_005075_O_2 |
| 28 | SNF1-related protein kinase | eucalyptusSpp_005102 | E. grandis | 225 | 118 | 1689 | 422 | Euc_005102_O_5 |
| 29 | RAS-like GTP-binding protein | eucalyptusSpp_005244 | E. grandis | 226 | 142 | 798 | 423 | Euc_005244_O_3 |
| 30 | 14-3-3 protein | eucalyptusSpp_005479 | E. grandis | 227 | 1011 | 258 | 424 | Euc_005479_O_2 |
| 31 | F-box family | eucalyptusSpp_005507 | E. grandis | 228 | 287 | 2062 | 425 | Euc_005507_O_4 |
| 32 | RAS-like GTP-binding protein | eucalyptusSpp_005653 | E. grandis | 229 | 41 | 691 | 426 | Euc_005653_O_2 |
| 33 | 1-aminocyclopropane- | eucalyptusSpp_005812 | E. grandis | 230 | 118 | 1080 | 427 | Euc_005812_O_2 |

TABLE 1-continued

Cell Signaling Genes and Corresponding Gene Products

| | | Gene Sequences | | | Protein | | | Oligonucleotide |
|---|---|---|---|---|---|---|---|---|
| SEQ ID NO | Target | ConsID | Species | SEQ ID NO | ORF Start | ORF Stop | SEQ ID NO | OligoID |
| 34 | 1-aminocyclopropane-1-carboxylate oxidase | eucalyptusSpp_005813 | E. grandis | 231 | 75 | 1037 | 428 | Euc_005813_O_1 |
| 35 | F-box family | eucalyptusSpp_006242 | E. grandis | 232 | 62 | 1192 | 429 | Euc_006242_O_4 |
| 36 | RAB5B | eucalyptusSpp_006353 | E. grandis | 233 | 194 | 796 | 430 | Euc_006353_O_3 |
| 37 | MAP kinase | eucalyptusSpp_006361 | E. grandis | 234 | 351 | 1541 | 431 | Euc_006361_O_2 |
| 38 | MAP kinase | eucalyptusSpp_006615 | E. grandis | 235 | 152 | 1279 | 432 | Euc_006615_O_3 |
| 39 | F-box family | eucalyptusSpp_006845 | E. grandis | 236 | 89 | 1693 | 433 | Euc_006845_O_1 |
| 40 | F-box family | eucalyptusSpp_007557 | E. grandis | 237 | 182 | 1927 | 434 | Euc_007557_O_1 |
| 41 | Mago Nashi protein | eucalyptusSpp_007597 | E. grandis | 238 | 114 | 572 | 435 | Euc_007597_O_2 |
| 42 | RAS-like GTP-binding protein | eucalyptusSpp_007971 | E. grandis | 239 | 218 | 865 | 436 | Euc_007971_O_2 |
| 43 | GA20-oxidase | eucalyptusSpp_008077 | E. grandis | 240 | 105 | 1262 | 437 | Euc_008077_O_2 |
| 44 | RAB7 | eucalyptusSpp_008134 | E. grandis | 241 | 158 | 781 | 438 | Euc_008134_O_1 |
| 45 | Steroid reductase | eucalyptusSpp_008349 | E. grandis | 242 | 522 | 1325 | 439 | Euc_008349_O_2 |
| 46 | Steroid reductase | eucalyptusSpp_008461 | E. grandis | 243 | 283 | 1587 | 440 | Euc_008461_O_2 |
| 47 | MAP kinase kinase | eucalyptusSpp_009014 | E. grandis | 244 | 86 | 1162 | 441 | Euc_009014_O_1 |
| 48 | RAN (GTPase activating protein) | eucalyptusSpp_009403 | E. grandis | 245 | 333 | 1958 | 442 | Euc_009403_O_1 |
| 49 | Synaptobrevin like | eucalyptusSpp_009707 | E. grandis | 246 | 303 | 959 | 443 | Euc_009707_O_3 |
| 50 | 1-aminocyclopropane-1-carboxylate synthase | eucalyptusSpp_010310 | E. grandis | 247 | 126 | 1586 | 444 | Euc_010310_O_4 |
| 51 | MAP kinase | eucalyptusSpp_010424 | E. grandis | 248 | 692 | 1801 | 445 | Euc_010424_O_4 |
| 52 | Synaptobrevin like | eucalyptusSpp_010831 | E. grandis | 249 | 46 | 714 | 446 | Euc_010831_O_3 |
| 53 | MAP kinase kinase kinase | eucalyptusSpp_010908 | E. grandis | 250 | 436 | 2538 | 447 | Euc_010908_O_5 |
| 54 | Synaptobrevin like | eucalyptusSpp_011066 | E. grandis | 251 | 188 | 901 | 448 | Euc_011066_O_3 |
| 55 | F-box family | eucalyptusSpp_011354 | E. grandis | 252 | 51 | 824 | 449 | Euc_011354_O_4 |
| 56 | F-box family | eucalyptusSpp_011918 | E. grandis | 253 | 147 | 1769 | 450 | Euc_011918_O_2 |
| 57 | Synaptobrevin like | eucalyptusSpp_012495 | E. grandis | 254 | 56 | 721 | 451 | Euc_012495_O_3 |
| 58 | RAS-like GTP-binding protein | eucalyptusSpp_012520 | E. grandis | 255 | 187 | 843 | 452 | Euc_012520_O_2 |
| 59 | F-box family | eucalyptusSpp_012653 | E. grandis | 256 | 268 | 1446 | 453 | Euc_012653_O_1 |
| 60 | Polyphoshoinositide binding protein SSH2P | eucalyptusSpp_014684 | E. grandis | 257 | 1565 | 275 | 454 | Euc_014684_O_4 |
| 61 | Indole-3-acetaldehyde reductase | eucalyptusSpp_014843 | E. grandis | 258 | 53 | 2071 | 455 | Euc_014843_O_1 |
| 62 | F-box family | eucalyptusSpp_015050 | E. grandis | 259 | 3 | 1115 | 456 | Euc_015050_O_1 |
| 63 | RAN (GTPase activating protein) | eucalyptusSpp_015957 | E. grandis | 260 | 215 | 1843 | 457 | Euc_015957_O_2 |
| 64 | MAP kinase kinase | eucalyptusSpp_016091 | E. grandis | 261 | 1314 | 331 | 458 | Euc_016091_O_2 |
| 65 | G protein-coupled receptor | eucalyptusSpp_016403 | E. grandis | 262 | 70 | 1047 | 459 | Euc_016403_O_3 |
| 66 | F-box family | eucalyptusSpp_016623 | E. grandis | 263 | 180 | 1733 | 460 | Euc_016623_O_4 |
| 67 | RAB5B | eucalyptusSpp_016847 | E. grandis | 264 | 131 | 790 | 461 | Euc_016847_O_1 |

TABLE 1-continued

Cell Signaling Genes and Corresponding Gene Products

| | Gene Sequences | | | | Protein | | Oligonucleotide | |
|---|---|---|---|---|---|---|---|---|
| SEQ ID NO | Target | ConsID | Species | SEQ ID NO | ORF Start | ORF Stop | SEQ ID NO | OligoID |
| 68 | 1-aminocyclopropane-1-carboxylate oxidase | eucalyptusSpp_017232 | *E. grandis* | 265 | 36 | 959 | 462 | Euc_017232_O_1 |
| 69 | Polyphosphoinositide binding protein | eucalyptusSpp_017284 | *E. grandis* | 266 | 69 | 1079 | 463 | Euc_017284_O_3 |
| 70 | RAB5B | eucalyptusSpp_017391 | *E. grandis* | 267 | 3 | 599 | 464 | Euc_017391_O_1 |
| 71 | F-box family | eucalyptusSpp_017393 | *E. grandis* | 268 | 18 | 1244 | 465 | Euc_017393_O_2 |
| 72 | 1-aminocyclopropane-1-carboxylate oxidase | eucalyptusSpp_017739 | *E. grandis* | 269 | 27 | 986 | 466 | Euc_017739_O_2 |
| 73 | Steroid sulfotransferase | eucalyptusSpp_017775 | *E. grandis* | 270 | 77 | 1090 | 467 | Euc_017775_O_4 |
| 74 | F-box family | eucalyptusSpp_017798 | *E. grandis* | 271 | 309 | 2063 | 468 | Euc_017798_O_2 |
| 75 | G protein-coupled receptor | eucalyptusSpp_018758 | *E. grandis* | 272 | 343 | 1635 | 469 | Euc_018758_O_3 |
| 76 | 1-aminocyclopropane-1-carboxylate oxidase | eucalyptusSpp_020648 | *E. grandis* | 273 | 2189 | 380 | 470 | Euc_020648_O_2 |
| 77 | Ethylene receptor | eucalyptusSpp_020951 | *E. grendis* | 274 | 147 | 2447 | 471 | Euc_020951_O_5 |
| 78 | RAS-like GTP-binding protein | eucalyptusSpp_021218 | *E. grandis* | 275 | 82 | 735 | 472 | Euc_021218_O_3 |
| 79 | Steroid sulfotransferase | eucalyptusSpp_021474 | *E. grandis* | 276 | 80 | 1114 | 473 | Euc_021474_O_1 |
| 80 | Synaptobrevin like | eucalyptusSpp_021708 | *E. grandis* | 277 | 99 | 761 | 474 | Euc_021708_O_1 |
| 81 | 1-aminocyclopropane-1-carboxylate oxidase | eucalyptusSpp_023492 | *E. grandis* | 278 | 3025 | 370 | 475 | Euc_023492_O_2 |
| 82 | Gibberellin 2-oxidase | eucalyptusSpp_024797 | *E. grandis* | 279 | 102 | 1085 | 476 | Euc_024797_O_1 |
| 83 | MAP kinase kinase kinase | eucalyptusSpp_028582 | *E. grandis* | 280 | 19 | 1101 | 477 | Euc_028582_O_3 |
| 84 | Steroid reductase | eucalyptusSpp_034316 | *E. grandis* | 281 | 201 | 1016 | 478 | Euc_034316_O_3 |
| 85 | Steroid sulfotransferase | eucalyptusSpp_035385 | *E. grandis* | 282 | 109 | 1116 | 479 | Euc_035385_O_1 |
| 86 | 14-3-3 protein | eucalyptusSpp_035910 | *E. grandis* | 283 | 25 | 798 | 480 | Euc_035910_O_1 |
| 87 | F-box family | eucalyptusSpp_039440 | *E. grandis* | 284 | 60 | 1172 | 481 | Euc_039440_O_4 |
| 88 | RAB7 | eucalyptusSpp_039852 | *E. grandis* | 285 | 77 | 697 | 482 | Euc_039852_O_2 |
| 89 | F-box family | eucalyptusSpp_040890 | *E. grandis* | 286 | 249 | 1154 | 483 | Euc_040890_O_1 |
| 90 | Steroid reductase | eucalyptusSpp_045179 | *E. grandis* | 287 | 107 | 1546 | 484 | Euc_045179_O_1 |
| 91 | Gibberellin 2-oxidase | eucalyptusSpp_046633 | *E. grandis* | 288 | 213 | 1208 | 485 | Euc_046633_O_4 |
| 92 | Steroid reductase | eucalyptusSpp_047001 | *E. grandis* | 289 | 77 | 1474 | 486 | Euc_047001_O_3 |
| 93 | 14-3-3 protein | pinusRadiata_000460 | *P. radiata* | 290 | 1157 | 259 | 487 | Pra_000460_O_2 |
| 94 | RAB7 | pinusRadiata_000760 | *P. radiata* | 291 | 84 | 683 | | no oligo |
| 95 | RAB7 | pinusRadiata_000761 | *P. radiata* | 292 | 154 | 774 | 488 | Pra_000761_O_1 |
| 96 | F-box family | pinusRadiata_001338 | *P. radiata* | 293 | 2672 | 546 | 489 | Pra_001338_ORF_O_1 |
| 97 | F-box family | pinusRadiata_001342 | *P. radiata* | 294 | 280 | 2088 | 490 | Pra_001342_O_4 |
| 98 | Synaptobrevin like | pinusRadiata_001591 | *P. radiata* | 295 | 51 | 743 | 491 | Pra_001591_O_2 |
| 99 | 14-3-3 protein | pinusRadiata_001729 | *P. radiata* | 296 | 332 | 1111 | 492 | Pra_001729_O_1 |
| 100 | MAP kinase kinase | pinusRadiata_001853 | *P. radiata* | 297 | 44 | 1057 | 493 | Pra_001853_O_1 |
| 101 | RAB5B | pinusRadiata_001859 | *P. radiata* | 298 | 388 | 990 | 494 | Pra_001859_O_1 |
| 102 | MAP kinase | pinusRadiata_001935 | *P. radiata* | 299 | 234 | 1352 | 495 | Pra_001935_O_1 |

TABLE 1-continued

Cell Signaling Genes and Corresponding Gene Products

| | Gene Sequences | | | | Protein | | Oligonucleotide | |
|---|---|---|---|---|---|---|---|---|
| SEQ ID NO | Target | ConsID | Species | SEQ ID NO | ORF Start | ORF Stop | SEQ ID NO | OligoID |
| 103 | RAB11J | pinusRadiata__001960 | P. radiata | 300 | 20 | 682 | 496 | Pra__001960__O__1 |
| 104 | RAB11J | pinusRadiata__001961 | P. radiata | 301 | 1037 | 223 | 497 | Pra__001961__ORF__O1 |
| 105 | RAB7 | pinusRadiata__002135 | P. radiata | 302 | 238 | 858 | | no oligo |
| 106 | RAB7 | pinusRadiata__002136 | P. radiata | 303 | 209 | 829 | | no oligo |
| 107 | RAB7 | pinusRadiata__002137 | P. radiata | 304 | 447 | 1139 | | no oligo |
| 108 | F-box family | pinusRadiata__002167 | P. radiata | 305 | 268 | 1761 | 498 | Pra__002167__O__2 |
| 109 | RAS-like GTP-binding protein | pinusRadiata__002192 | P. radiata | 306 | 693 | 1343 | 499 | Pra__002192__O__2 |
| 110 | 14-3-3 protein | pinusRadiata__002262 | P. radiata | 307 | 126 | 908 | 500 | Pra__002262__O__1 |
| 111 | 14-3-3 protein | pinusRadiata__002264 | P. radiata | 308 | 1235 | 260 | 501 | Pra__002264__ORF__O__4 |
| 112 | 14-3-3 protein | pinusRadiata__002278 | P. radiata | 309 | 268 | 1047 | 502 | Pra__002278__O__1 |
| 113 | SNF1-related protein kinase | pinusRadiata__002328 | P. radiata | 310 | 686 | 2221 | 503 | Pra__002328__O__1 |
| 114 | Indole-3-acetaldehyde reductase | pinusRadiata__002633 | P. radiata | 311 | 487 | 2121 | 504 | Pra__002633__O__1 |
| 115 | Indole-3-acetaldehyde reductase | pinusRadiata__002634 | P. radiata | 312 | 61 | 1704 | 505 | Pra__002634__O__2 |
| 116 | GAI giberellic acid insensitive | pinusRadiata__003369 | P. radiata | 313 | 490 | 2628 | | no oligo |
| 117 | Ethylene-responsive elongation factor EF-TS | pinusRadiata__003503 | P. radiata | 314 | 291 | 1499 | 506 | Pra__003503__ORF__O1 |
| 118 | MAP kinase | pinusRadiata__003519 | P. radiata | 315 | 219 | 1337 | 507 | Pra__003519__O__1 |
| 119 | 1-aminocyclopropane-1-carboxylate oxidase | pinusRadiata__003795 | P. radiata | 316 | 132 | 1133 | | no oligo |
| 120 | 1-aminocyclopropane-1-carboxylate oxidase | pinusRadiata__003797 | P. radiata | 317 | 31 | 1056 | 508 | Pra__003797__O__2 |
| 121 | RAS-like GTP-binding protein | pinusRadiata__003807 | P. radiata | 318 | 472 | 1140 | 509 | Pra__003807__O__1 |
| 122 | Polyphosphoinositide binding protein SSH2P | pinusRadiata__003928 | P. radiata | 319 | 48 | 863 | 510 | Pra__003928__ORF__O1 |
| 123 | 14-3-3 protein | pinusRadiata__003961 | P. radiata | 320 | 164 | 940 | 511 | Pra__003961__O__4 |
| 124 | Synaptobrevin like | pinusRadiata__004131 | P. radiata | 321 | 1543 | 219 | 512 | Pra__004131__O__1 |
| 125 | RAS-like GTP-binding protein | pinusRadiata__004155 | P. radiata | 322 | 214 | 855 | 513 | Pra__004155__O__2 |
| 126 | F-box family | pinusRadiata__004503 | P. radiata | 323 | 151 | 1908 | 514 | Pra__004503__O__1 |
| 127 | MAP kinase | pinusRadiata__004512 | P. radiata | 324 | 505 | 2235 | 515 | Pra__004512__O__1 |
| 128 | Mago Nashi protein | pinusRadiata__004937 | P. radiata | 325 | 369 | 818 | 516 | Pra__004937__ORF__O2 |
| 129 | Mago Nashi protein | pinusRadiata__004939 | P. radiata | 326 | 221 | 700 | 517 | Pra__004939__O__1 |
| 130 | Polyphosphoinositide binding protein | pinusRadiata__005336 | P. radiata | 327 | 1902 | 317 | 518 | Pra__005336__ORF__O2 |
| 131 | Steroid reductase | pinusRadiata__005664 | P. radiata | 328 | 41 | 1498 | 519 | Pra__005664__O__1 |
| 132 | Polyphosphoinositide binding protein SSH2P | pinusRadiata__006109 | P. radiata | 329 | 60 | 872 | 520 | Pra__006109__ORF__O1 |
| 133 | MAP kinase kinase kinase | pinusRadiata__006207 | P. radiata | 330 | 584 | 1453 | 521 | Pra__006207__O__2 |
| 134 | MAP kinase kinase kinase | pinusRadiata__006211 | P. radiata | 331 | 61 | 2700 | 522 | Pra__006211__O__2 |

TABLE 1-continued

Cell Signaling Genes and Corresponding Gene Products

| SEQ ID NO | Target | ConsID | Species | Protein SEQ ID NO | ORF Start | ORF Stop | SEQ ID NO | OligoID |
|---|---|---|---|---|---|---|---|---|
| 135 | Steroid reductase | pinusRadiata_006556 | P. radiata | 332 | 1 | 1464 | 523 | Pra_006556_ORF_O2 |
| 136 | Steroid reductase | pinusRadiata_006558 | P. radiata | 333 | 89 | 1555 | 524 | Pra_006558_O_1 |
| 137 | MAP kinase | pinusRadiata_006562 | P. radiata | 334 | 187 | 1920 | 525 | Pra_006562_O_5 |
| 138 | RAS-like GTP-binding protein | pinusRadiata_006604 | P. radiata | 335 | 186 | 839 | 526 | Pra_006604_O_1 |
| 139 | F-box family | pinusRadiata_006664 | P. radiata | 336 | 715 | 2442 | 527 | Pra_006664_O_5 |
| 140 | Synaptobrevin like | pinusRadiata_006899 | P. radiata | 337 | 231 | 896 | 528 | Pra_006899_O_1 |
| 141 | Synaptobrevin like | pinusRadiata_006947 | P. radiata | 338 | 287 | 949 | 529 | Pra_006947_O_2 |
| 142 | Steroid sulfotransferase | pinusRadiata_006962 | P. radiata | 339 | 71 | 1204 | 530 | Pra_006962_ORF_O2 |
| 143 | Synaptobrevin like | pinusRadiata_007855 | P. radiata | 340 | 112 | 774 | 531 | Pra_007855_O_2 |
| 144 | MAP kinase kinase | pinusRadiata_007911 | P. radiata | 341 | 2618 | 513 | 532 | Pra_007911_O_4 |
| 145 | MAP kinase | pinusRadiata_007918 | P. radiata | 342 | 1162 | 2274 | 533 | Pra_007918_O_1 |
| 146 | F-box family | pinusRadiata_008017 | P. radiata | 343 | 124 | 2067 | 534 | Pra_008017_O_1 |
| 147 | MAP kinase | pinusRadiata_008128 | P. radiata | 344 | 59 | 1231 | 535 | Pra_008128_O_3 |
| 148 | Steroid reductase | pinusRadiata_008715 | P. radiata | 345 | 18 | 1406 | 536 | Pra_008715_O_2 |
| 149 | Cytokinin oxidase | pinusRadiata_009284 | P. radiata | 346 | 29 | 1717 | 537 | Pra_009284_O_2 |
| 150 | G protein-coupled receptor | pinusRadiata_009432 | P. radiata | 347 | 424 | 1368 | 538 | Pra_009432_O_1 |
| 151 | RAS-like GTP-binding protein | pinusRadiata_009540 | P. radiata | 348 | 581 | 1228 | 539 | Pra_009540_O_2 |
| 152 | Ethylene receptor | pinusRadiata_009549 | P. radiata | 349 | 585 | 2825 | 540 | Pra_009549_O_2 |
| 153 | RAB7 | pinusRadiata_009741 | P. radiata | 350 | 147 | 767 | 541 | Pra_009741_O_1 |
| 154 | F-box family | pinusRadiata_009788 | P. radiata | 351 | 240 | 1964 | 542 | Pra_009788_O_2 |
| 155 | Synaptobrevin like | pinusRadiata_010012 | P. radiata | 352 | 437 | 1096 | 543 | Pra_010012_O_1 |
| 156 | Indole-3-acetonitrilase | pinusRadiata_010045 | P. radiata | 353 | 433 | 1473 | 544 | Pra_010045_O_3 |
| 157 | RAB11G | pinusRadiata_010668 | P. radiata | 354 | 150 | 803 | 545 | Pra_010668_O_1 |
| 158 | 1-aminocyclopropane-1-carboxylate oxidase | pinusRadiata_010871 | P. radiata | 355 | 68 | 1060 | 546 | Pra_010871_O_1 |
| 159 | MAP kinase | pinusRadiata_010893 | P. radiata | 356 | 141 | 1247 | 547 | Pra_010893_O_1 |
| 160 | MAP kinase kinase kinase | pinusRadiata_010981 | P. radiata | 357 | 35 | 1480 | 548 | Pra_010981_O_3 |
| 161 | MAP kinase kinase | pinusRadiata_010995 | P. radiata | 358 | 159 | 1115 | 549 | Pra_010995_ORF_O2 |
| 162 | MAP kinase | pinusRadiata_011965 | P. radiata | 359 | 318 | 1424 | 550 | Pra_011965_O_1 |
| 163 | F-box family | pinusRadiata_012292 | P. radiata | 360 | 988 | 2790 | 551 | Pra_012292_ORF_O1 |
| 164 | Polyphosphoinositide binding protein SSH2P | pinusRadiata_012454 | P. radiata | 361 | 174 | 944 | 552 | Pra_012454_ORF_O1 |
| 165 | RAB11G | pinusRadiata_012693 | P. radiata | 362 | 1110 | 216 | 553 | Pra_012693_O_1 |
| 166 | F-box family | pinusRadiata_013112 | P. radiata | 363 | 828 | 2297 | 554 | Pra_013112_O_1 |
| 167 | Indole-3-acetaldehyde reductase | pinusRadiata_013120 | P. radiata | 364 | 255 | 1748 | 555 | Pra_013120_O_1 |
| 168 | MAP kinase kinase | pinusRadiata_013449 | P. radiata | 365 | 379 | 1428 | 556 | Pra_013449_O_3 |
| 169 | F-box family | pinusRadiata_013718 | P. radiata | 366 | 91 | 2850 | 557 | Pra_013718_O_2 |
| 170 | MAP kinase | pinusRadiata_013908 | P. radiata | 367 | 745 | 2466 | 558 | Pra_013908_O_1 |
| 171 | Cytokinin oxidase | pinusRadiata_014246 | P. radiata | 368 | 2523 | 572 | 559 | Pra_014246_O_1 |
| 172 | F-box family | pinusRadiata_014765 | P. radiata | 369 | 151 | 1908 | | no oligo |

TABLE 1-continued

Cell Signaling Genes and Corresponding Gene Products

| | Gene Sequences | | | | Protein | | Oligonucleotide | |
|---|---|---|---|---|---|---|---|---|
| SEQ ID NO | Target | ConsID | Species | SEQ ID NO | ORF Start | ORF Stop | SEQ ID NO | OligoID |
| 173 | Gibberellin 2-oxidase | pinusRadiata_015681 | P. radiata | 370 | 6 | 1031 | 560 | Pra_015681_O_2 |
| 174 | Polyphosphoinositide binding protein SSH2P | pinusRadiata_015966 | P. radiata | 371 | 53 | 829 | | no oligo |
| 175 | 1-aminocyclopropane-1-carboxylate oxidase | pinusRadiata_016432 | P. radiata | 372 | 79 | 1050 | 561 | Pra_016432_O_2 |
| 176 | F-box family | pinusRadiata_016828 | P. radiata | 373 | 125 | 1531 | 562 | Pra_016828_O_2 |
| 177 | GAI giberellic acid insensitive | pinusRadiata_017416 | P. radiata | 374 | 118 | 1902 | 563 | Pra_017416_O_3 |
| 178 | Phytochrome A | pinusRadiata_017652 | P. radiata | 375 | 58 | 3532 | 564 | Pra_017652_O_3 |
| 179 | RAB5B | pinusRadiata_018337 | P. radiata | 376 | 231 | 833 | 565 | Pra_018337_O_2 |
| 180 | 14-3-3 protein | pinusRadiata_018748 | P. radiata | 377 | 35 | 778 | 566 | Pra_018748_O_2 |
| 181 | Steroid reductase | pinusRadiata_019345 | P. radiata | 378 | 25 | 1452 | 567 | Pra_019345_O_1 |
| 182 | Synaptobrevin like | pinusRadiata_019839 | P. radiata | 379 | 63 | 740 | 568 | Pra_019839_ORF_O_3 |
| 183 | F-box family | pinusRadiata_020271 | P. radiata | 380 | 306 | 1094 | 569 | Pra_020271_O_1 |
| 184 | RAN (GTPase activating protein) | pinusRadiata_021096 | P. radiata | 381 | 210 | 1853 | 570 | Pra_021096_O_2 |
| 185 | 14-3-3 protein | pinusRadiata_022578 | P. radiata | 382 | 180 | 968 | 571 | Pra_022578_ORF_O2 |
| 186 | RAS-like GTP-binding protein | pinusRadiata_022829 | P. radiata | 383 | 286 | 930 | 572 | Pra_022829_O_1 |
| 187 | Steroid reductase | pinusRadiata_022951 | P. radiata | 384 | 75 | 1208 | 573 | Pra_022951_O_2 |
| 188 | F-box family | pinusRadiata_023140 | P. radiata | 385 | 167 | 2005 | 574 | Pra_023140_O_4 |
| 189 | Steroid reductase | pinusRadiata_023522 | P. radiata | 386 | 317 | 1261 | 575 | Pra_023522_O_1 |
| 190 | RAS-like GTP-binding protein | pinusRadiata_023629 | P. radiata | 387 | 298 | 945 | 576 | Pra_023629_O_2 |
| 191 | 14-3-3 protein | pinusRadiata_024074 | P. radiata | 388 | 86 | 859 | 577 | Pra_024074_O_2 |
| 192 | 14-3-3 protein | pinusRadiata_025093 | P. radiata | 389 | 203 | 1048 | 578 | Pra_025093_O_1 |
| 193 | 1-aminocyclopropane-1-carboxylate oxidase | pinusRadiata_025459 | P. radiata | 390 | 159 | 1238 | 579 | Pra_025459_O_1 |
| 194 | Synaptobrevin like | pinusRadiata_025638 | P. radiata | 391 | 183 | 1073 | 580 | Pra_025638_O_2 |
| 195 | 14-3-3 protein | pinusRadiata_026397 | P. radiata | 392 | 141 | 929 | 581 | Pra_026397_O_1 |
| 196 | RAS-like GTP-binding protein | pinusRadiata_027059 | P. radiata | 393 | 70 | 711 | 582 | Pra_027059_O_2 |
| 197 | F-box family | pinusRadiata_027138 | P. radiata | 394 | 167 | 2005 | 583 | Pra_027138_O_1 |

TABLE 2

Cell Signaling Gene Sequences

| SEQ ID NO | Sequence |
|---|---|
| 1 | GCAAGCTAAGCTAAGGGAGCGGTTACCCTCGCGAAAGCAAGAACCTT TCAGTTCACGCAGAAGAGAGAGAAAGAAAGAGAGAGATGGAGAGGGA GAGAGAGCAGCAGGTTTACCAGGCGAGGCTCGCGGAGCAAGCCGAGC GATACGATGAGATGGTTGAGTCGATGAAGCAAGTAGCTAAGCTGGAT GTGGAACTGACTGTTGAGGAGAGAAATGTGTTGTCTGTTGGGTATAA GAATGTGATTGGGGCCAGAAGGGCATCATGGCGGATTTTATCTTCCA |

TABLE 2-continued

Cell Signaling Gene Sequences

| SEQ ID NO | Sequence |
|---|---|
| | TTGAGCAGAAGGAGGGGACCAAGGGTAACGAGCAGAATGTGAAGAGG<br>ATCAAGGACTACAGGCAAAGGGTTGAAGATGAGCTCGCCAAGATCTG<br>CAGTGACATACTCTCAGTCATTGATAAGCATCTTATCCCATCCTCCT<br>CAAGTGGAGAGTCGACTGTTTTCTACTATAAGATGAAAGGTGATTAT<br>TGTCGTTACCTTGCTGAATTCAAGGCTGGTGATGACCGCAAAGAAGC<br>TGCTGATCAGTCGCTCAAGGCATATGAGGCTGCCAGTTCCACTGCTT<br>CAACGGATTTGGCTCCAACTCACCCTATCAGACTTGGACTGGCTTTG<br>AATTTCTCCGTCTTCTATTATGAAATCATGAACTCGCCAGAAAGGGC<br>ATGCCATCTGGCTAAACAAGCTTTTGATGAGGCTATCGCGGAACTCG<br>ATAGCCTAAATGAAGACTCCTATAAGGACAGTACCCTCATTATGCAA<br>CTTCTTAGGGACAATCTTACACTATGGACTACAGATCTGCCTGAAGA<br>AGGAGGTGAGCAATCCAAAGTTGATGAGCCTGCGGCAGAGAGTTAAT<br>TGGGCAAAGTAGACGCTTCCTGATGATTTCAATTCTTTGGGGGACAT<br>TGAGGCTTGCTAGGGCAGGAGTCATGGTCTTATGCGATGGTGCAGTT<br>AGTAGACTGTTGGTCTGTATTTACTTATTTAACAGAATGCTTCTCCA<br>CAGTGTTGTGTTTGTGCTGGTTACACGATTGAATACTGTTATCTTTG<br>TCCTATAAAACACGGAAGCCTTTTCTCAAAAAAAAAA |
| 2 | GGAGAAGCGCCTTTTTTTTCCTTTCTCTCTCCCTTGCTTTCGTTTCT<br>CCATTTGTGGTTTTTCCGTTTTTTCCACGTCGCTCCCAGCGGATACG<br>CGTCTTCCGCCACCTCATCTCGCCCCGCCGTATAAATTCGGAGTCCT<br>CCCTGGCGCACTCCCCTCTCGCGTCCGTCCGCAAAACACTCCCCCCG<br>CCCGCAGCTCGCTCCGCCCGGCTTTTTCTCGCTCGCTCGCTCGCGAT<br>TCTTGCTCTTCCGCAAATCCCTAGTCGAGAGTTAGGTTTCGTAACAG<br>TACACGGAAGATGTCGCCCTCTGATTCTTCACGGGAGGAATATGTGT<br>ACATGGCCAAGTTAGCTGAACAGGCTGAGCGGTACGAGGAGATGGTG<br>GATTTCATGGAGAAAGTTGCCAAGACTGTAGACGTCGAGGAGCTAAC<br>CGTTGAGGAACGTAACCTTTTGTCTGTGGCGTACAAGAATGTGATTG<br>GGGCCAGGAGGGCATCGTGGAGGATCATTTCTTCCATTGAGCAGAAG<br>GAAGAGAGCAGGGGTAACACTGATCATGTCTCGATCATTAAGGACTA<br>CAGGGGAAAGATCGAGTCCGAGCTCAGCAAGATCTGTGAAGGCATTC<br>TCAGCCTTCTTGAGTCGCATCTCATTCCTTCAGCCTCCTCTGCTGAG<br>TCCAAGGTGTTTTACCTTAAGATGAAAGGTGATTACCACAGGTATCT<br>GGCAGAGTTTAAGACTGCGACTGAAAGGAAAGAAGCTGCCGAGAGCA<br>CTTTATTGGCCTACAAATCTGCTCAGGATATTGCTGGGGCCGAACTG<br>GCTTCTACTCACCCAATTAGGCTGGGACTTGCGCTGAACTTCTCTGT<br>TTTCTACTATGAAATACTTAACTCTCCTGATCGGGCTTGCGCTCTTG<br>CAAAGCAGGCATTTGATGAGGCCATCGCTGAGTTGGATACGCTGGGC<br>GAGGAATCATCAAGGACAGTACATTGATCATGCAACTTCTTCGAGA<br>TAACTTGACTCTGTGGACTTCTGATCTCACGGATGAAGCTGGGGATG<br>ACATTAAGGAAGCTTCGAAACTGGAGTCTGGAGAGGGGCAGCAATGA<br>TTTGCTAGGATGATGTCAGTACTTTAATGATATTTTGCACCGTCGTA<br>GATGCCTTGTGGTTTGTCACAGTGAAGATTATTTATGAACTGAGAGT<br>GCTATAAGTTGTTTCTCTAGTGTTCCTTGAAAAAAAAAA |
| 3 | CAAAAGCAATCTACATTTCTTTCTTTGATTACCAGGACAAATAAAAT<br>AAGATGCTATACCAGAGCAGTATCAGTGTTACACAAGAATCAAATAG<br>GATTTGGCACCTCAAAGGCAGATAAATTGATTAAATGGCCACAAATT<br>GGAAAGCATCATTCAAAAGATAAGTCACAAGAGCTCCTCAAACCTGA<br>ACAATAAATTATATTCACCATGACCACAGCAATGAGCATCACATGAT<br>TGAGAATCTCGTTGCACAAGCCCACAAGACAGGTGAACTATCAATCT<br>GACTTTCTTGGCCATCCAAAGCAGTGATTCCTCATTGTAAAAATTTA<br>ATCAATCTTTTGCTATTAGGCAATTCTTCCATAGTCTTTTCTTCCAC<br>GAGTTGTTGGAGGTATGTTTGTGAAAGCATCACTGGCCCTTCGCCCC<br>CACTCTCGCTCACCTCCGAACGAGAGAGTCCCAATCATTCGCAGCTT<br>CGCAGCTTTTGTAATTTGATCAGCACGTTGAAGATGGCGGCAGCTGA<br>TTCTTCACGCGAGGAAAATGTGTACATGGCCAAGTTGGCTGAACAGG<br>CCGAGCGTTATGAGGAAATGGTGGAATTTATGGAGAAAGTGGCCAAG<br>ACGGTTGATGTCGAGGAGCTTACTGTTGAGGAACGTAACCTCCTCTC<br>CGTGGCATACAAGAATGTGATTGGTGCCAGGAGGGCTTCATGGAGGA<br>TCATCTCTTCCATTGAGCAGAAGGAAGAGAGCAGGGGAAATGAGGAC<br>CATGTTGTGATTATCAAGGAGTATAGGGGAAGATTGAGACTGAGCT<br>CAGCAAGATCTGTGATGGCATCCTCAATCTCCTTGAGTCGCATCTCG<br>TTCCATCAGCCTCATCTGCTGAGTCAAAGGTGTTCTATCTGAAGATG<br>AAGGGTGATTACCACAGGTACTTGGCTGAGTTTAAGGCGGGAACTGA<br>GAGGAAAGAGGCTGCTGAGAGCACCTTGTTGGCTTATAAATCTGCTC<br>AGGATATTGCTTTGGCTGAGCTGGCTCCCACTCACCCTATTAGGCTT<br>GGACTTGCTCTTAACTTCTCTGTGTTCTATTATGAAATTCTCAACTC<br>ACCTGATCGTGCCTGCAGTCTGGCTAAACAGGCATTTGATGAGGCTA<br>TCTCCGAGCTAGATACATTGGGTGAGGAATCATACAAGGACAGCACA<br>TTGATTATGCAACTTCTCCGAGATAACCTAACACTCTGGACTTCCGA<br>TGTCACGGATGAAGCTGGAGATGAGATCAAGGAATCTTCAAAAAGGG<br>AGTCTGGTGAGGGGCAGCCACCACAGTGACGAGCTCCATTCGAAGAT |

TABLE 2-continued

Cell Signaling Gene Sequences

| SEQ ID NO | Sequence |
|---|---|
|  | GGCTTCTCTGTACTTTAAGACTGTGAACTCTTATGTAGGCAGCGCTT<br>TGTTATAACATCATTTGGTCAGCACCATGATCTTAGTACTTGCACTG<br>CTTTTGGGTGAAAGTATTATGGGACTGTGTACTTTTCTCTGGTTAGT<br>TATGGGAAGAGATTGACTTGATGCAGTGCTCTGTTTTGTCTCGTGGT<br>AGTGATGTCAGTGGTTTTCTTATTGTGAAGTGAATAATTCTATAGAC<br>TCACACTACCAATGGTTCACAAAGTGATTGTGGTAGACATATGTCGA<br>GTGCTTTAATTGGTTCGCCGTTTCATGTCAAATGCTATCACCTTTTG<br>CCAAAAAAAAAA |
| 4 | GCGTCGTCCTCCTTCCTCCTCCCCCTTCCTCACCAGCCAGTCGTCGT<br>CTGCTTGAGGGCTAGAGAGAGAGAGAGTAGAGAGAGAGTAGAGAG<br>AGAGTGTAGAGAGAGAGAGAGAGAGAGAAGGAGATGGCGTCGACGAA<br>GGAGAGAGACGGCTACGTCTACGTCGCCAAGCTCGCCGAGCAGGCCG<br>AGCGCTACGACGAAATGGTGGAGGCCATGAAGAATGTGGCGAAGCTC<br>GATGTGGAGCTGACGGTGGAAGAGAGGAACCTGCTCTCCGTCGGTTA<br>CAAGAACGTGATCGGCGCGCGGCGGGCGTCGTGGAGGATCCTCTCTT<br>CCATCGAGCAGAAGGAGGACTCGAAAGGGAACGAGCATAATGTGAAG<br>AAGATCAAGGAGTTCAGGCAGAAGGTCGAGGCCGAGCTGGCGAATAT<br>CTGCGGGGATGTGATGAAGGTGATCGATGAGCATTTGATTCCTTCGT<br>GTGCTGGTGGAGAATCGACCGTGTTTTTCTATAAAATGAAAGGAGAT<br>TACTATCGGTACTTGGCAGAGTTTAAGGCTGGTGATGACAGAAAGGA<br>GGCAGCTGATCAGTCTATGAAAGCATATGAGCTGGCTTCCACCACCG<br>CAGAGGCTGACCTATCCCCGACACATCCAATCAGATTGGGTTTGGCA<br>TTGAACTTTTCTGTCTTCTACTATGAGATCATGAACTCTCCTGAAAG<br>GGCCTGTCACCTTGCAAAGCAGGCTTTTGACGAAGCGATCTCAGAGT<br>TGGATACTTTGAGTGAGGAATCCTACAAAGACAGCACATTAATTATG<br>CAGCTTCTAAGGGACAATCTGACATTATGGACTTCTGACATCCCTGA<br>GGATGGAGCTGAAGATGCTCAGAAGCTTGACAATGCTGCCAAAGCTG<br>CAGGAGGTGAAGATGCAGAGTGAGGCAGAGTGTTGCTTGGGAGCTCA<br>TAAAGGGAGTCAAATGGTTTGAGGGTGGTGTTTCCTTGTCTGAAGGC<br>ATATTGAGAGACTTTTACTTTCTGTTTCCTTCACTTTTTTCGTTTCG<br>TCGTCCTCTTTTGCTTCGACATTGCTACTAGCTAATTATTTGGTGCT<br>TGTTCTGTGCTCCCATTCTCACGTCTGCTGATTAAACCTGATAAAAA<br>TTATGTCAAGACAGTCTGTTGTACGATCTAAGTCTGTTTAATTGAGA<br>ATGTAGCGTTATTAGATGATGAATCTCAACAGTTGTGCAATCGGATG<br>TTAAGGCCTACTTGTTAATCTAAAAAAAAAA |
| 5 | AAGAGATGGCAGAGCACCGCAGCTATGGAAATGTGAATCTAAAGACG<br>TTTGATGCTCATGTTCCGGAGATTAAGTTCACCAAGCTCTTCATCGA<br>CGGCGAGTTCGTCGATTCTGTCAAAGGAAGGACATTCGAGACGAAAG<br>ATCCAAGAAATGGACAAGTGGTGGCAAGAGTCGCGGAGGGAGACGAA<br>GAGGACGTGGAGTTGGCCGTGATTGCTGCCCGTCGAGCATTTGATCA<br>CGGCCCTTGGCCACGCATGCCCGGCTATCAAAGGGGAAGGATCATGT<br>CAAAATTTGCAGACTTGATCGAAGAGAACATAGACGAACTAGCTGCT<br>CTGGACACTATAGATGCCGGGAAGCTATTCAGTGTCGGCAAGGCCCG<br>GGACATTCCTAACGCTGCCATGCTGCTGAGGTACTATGCCGGTGCGG<br>TGGATAAGATCCACGGCGAGGTATTGAAGATGTCGCGCGAGCTTCAC<br>GGGTACACGCTACGGGAGCCGGTTGGCGTGATCGGGCACATCATCCC<br>TTGGAACTTCCCGACCGGGGTGTTCTTCATGAAGGTCGCCCCAACAC<br>TGGCGGCTGGTTGCACCATGATCGTGAAGCCCGCCGAGCAAACCCCT<br>CTATCGGCTCTCTTTTACGCTCATTTGGCTAAGAAGGCTGGTGTTCC<br>TGATGGAGTGATCAATGTCGTTACCGGTTTTGGACCGACAGCTGGTG<br>CAGCGATAAGTAGTCATATGGACATTGATATGGTTAGTTTTACGGGG<br>TCTACAAAAGTAGGACACATGGTGATGCAGGCCGCGGCAACGAGCAA<br>TTTGAAACAAGTGTCGCTTGAATTGGGGGCAAATCACCTCTTATAG<br>TCTTTGATGATGTCGATTTAGATACCGCTACTAATCTTGCTCTGACT<br>GGTATCCTCTATAACAAGGGAGAAGTATGCGTCGCAGGATCTCGTGT<br>CTATGTTCAAGAAGCGATCTATGAAGAATTCGAGAAGAAGCTAGTGG<br>CAAAGGCCAAGGCTTGGCCGGTCGGTGACCCATTTGATCCGAATGTC<br>CGTCAAGGACCGCAGGTCGATAAGAAACAGTTTGAGAAAATACTTTC<br>TTACATCGAGCATGGAAAGAGAGAAGGAGCTACACTTTTGATTGGGG<br>GTGAGCGTCTAGGCACCGAAGGGTACTACATTCAGCCAACAATCTTC<br>ACAGATGTTAATGAGGACAATGTGATCGTAAAGGATGAGATTTTCGG<br>CCCCGTCATGTCACTCATGAAATTCAAGACCATGGAGGAGGTGATCA<br>AGAGGGCCAATGACACGAGGTACGGTCTAGCGGCGGGAATTCTGACA<br>AAGAACATAGATCTAGCAAACACGGTCTCAAGGTCAATCCGAGCAGG<br>TATGATTTGGATAAATTGCTACCTTGCAGTTGACAACGACTGTCCTT<br>ATGGTGGCTACAAGATGAGTGGCTTTGGCAAAGATCTTGGCTTGGAC<br>GCTCTCCACAAATACCTACATGTCAAATCTATCGTGACCCCCATTTA<br>TAACTCTCCCTGGCTTTGAGAGAGTTTTTTTTTTCTTAGTGGGCGCT<br>GGATTGCATCATCAGACGGGTCAAATAATATATAATTAGAAGTGTAT<br>TTGTTTGAGTGAAAATATTTTTCCCGAAAAAAAAAA |

TABLE 2-continued

Cell Signaling Gene Sequences

| SEQ ID NO | Sequence |
|---|---|
| 6 | AGGAGAGAGACGAGATGGCAGAGAACCAGAGCGACGCCAACGGGAGC
CTGAAGACTTATGATGAACACGTTCCGGACATCAAGTTTACCAAGCT
CTTCATCAATGGCGAGTTCGTCGATTCTGTCAAAGGGAGGACGTTCG
AGACGATAGATCCAAGAAATGGAGAAGTTACAGCAAGAGTTGCAGAG
GGAGACAAAGAGGACGTGGATTTGGCTGTGAAAGCCGCCCGTCAAGC
ATTTGATCACGGCCCTTGGCCACGCATGCCCGGCTACCAAAGGGGAA
GGATCATGTCGAAATTTGCGGACTTGATCGAAGAGAACATAGATGAA
CTGGCTGCTCTGGACACTATCGACGCCGGGAAGATATTCAGCATGGG
CAAGGCCGTGGACATCCCTCACGCTGCCACATGTCTAAGGTATTATG
CCGGCGCAGCGGACAAGATCCATGGTGAGGTGTTGAAGATGTCGCGT
GAACTTCATGGGTACACGCTGCTGGAGCCGGTTGGCGTGGTCGGGCA
CATTATCCCTTGGAACTTCCCGACCAGCATGTTCTTTATGAAGGTCG
CCCCAGCACTGGCGGCTGGTTGCACCATGATCGTGAAGCCTGCCGAG
CAGACCCCTCTGTCGGCTCTCTATTATGCTCATTTGGCTAAGAAGGC
CGGTGTTCCTAATGGAGTGATCAATGTTGTAACTGGTTTCGGACCAA
CGGCCGGTGCTGCAATAACCAGTCATATGGACATTGATATGGTCAAT
TTTACGGGGTCTACAAAAGTGGGGCGCATCGTGATGCAGACTGCAGC
GACAAGCAATTTGAAACAAGTGTCACTCGAATTAGGCGGGAAATCGC
CTATTATGATATTTGATGATGCTGATTTAGATACTGCTACCGATCTT
GCTCTAATAGGTATCGTCCATAACAAGGGAGAAATATGCGTCGCGGG
CTCTCGCGTTTATGTTCAGGAAGGGATCTATGAAGAGTTTGAGAAGA
AGCTGGTGGCAAAGGCAAAGGCTTGGCCAGTCGGTGACCCATTTGAT
CCGAAAGTCCAACAAGGACCGCAGGTCGATAAGAAACAATTTGAAGA
GATACTTTCTTATATCGAGCATGGAAAGAGAGAAGGGGCCACGCTTT
TGACTGGGGGCGAGCGTTTGGGCACCAAAGGGTACTATGTTCAGCCA
ACAATTTTCACAAATGTTAAGGAGGACAATGTGATCGTGAAGGATGA
GATTTTTGGTCCTGTCATGTCGCTCATGAAATTCAAGACTGTGGAGG
AGGCGATCAAGAGGGCTAACGATACTAGGTATGGTCTAGCAGCAGGG
ATTGTGACGAAGAATATAGATGTGGCGAACACAGTCTCGAGGTCAAT
TCGAGCGGGTGTCATATGGATAAACTGCTACTTTGCATTCGACAATG
ACTGTCCTTGTGGTGGTTACAAGACAAGCGGCTTCGGGAGAGATCTC
GGTTTGGATGCCCTCCACAAATGCCTACATGTTAAATCTATTGTGAC
CCCGCTTTATAACTCTCCATGGCTTAAGAGAATTTTCTAGGAAAAG
AGCTTTGAGTCATATGGTGGCTCAAATAATGTGTAATTCCAAATTAT
GAGGTATATTTGCAATAAACAAAATGCAGGTCATTTTGGCAAAAAAA
AAAAAAAAAAAAAGCAAGTGTCAAAGCCATTCTAGTCCACTTGCCTT
GGTGGAATGGGTTTGTTGTGTATTCTTAAATGATCTGCCCTACTCTC
TGCTCCTTTGTCGTCTTTTATATATTTTTGATATTGGTAATGAGGAG
ATGAATTCTTCTGTGTCCTTTGTATGTCTTATAGTCTGATATCATCA
TGAGTGATGAAGTTGGTCGAAGAGCATATTGTGCAAACTGCTAAACT
TGAGTTGTACTATGGGGGGTTTACAGTTTAAAAAAAAAA |
| 7 | GGATTTTGAGTGCAGAGATGAGAGAGAGGGAGATGGCAGAGAACCAG
AGCAATGCCAACGGGAGCCTGAAGACTTATGATGCTCATGTTCCAGA
GATTAAATTCACCAAGCTCTTCATCAATGGCAAGTTCGTCGATTCTG
TCAAAGGGAGGACATTGGAGACGATAGATCCAAGAAATGGACAAGCG
ACGGCGAGAGTTGCCGAGGGAGACAAAGAGGACGTGGATTTGGCTGT
CAAAGCTGCCCGCCAAGCATTTGATCACGGCCCCTGGCCGCGCATGC
CCGGCTATCAAAGGGGAAGGATCATGTCGAAATTTGCGGACTTAATC
GAAGAGAACATAGACGAACTAGCTGCTCTGGACACTATAGATGCCGG
GAAGCTATTTAGTGTCGGCAAGGCCCAGGACATCCCTCACGCTGCCA
CGATGCTGAGGTACTATGCGGGTGCAGCGGATAAGATCCACGGCGAG
GTATTGAAGATGTCGCGCGAGCTTCACGGGTACACGCTACGGGAGCC
GGTTGGCGTGATCGCGCACATCATCCCTTGGAACTTCCCGACCGCGG
TGTTCTTTATGAAGGTCGCCCCAGCGCTGGCGGCTGGTTGCACCATG
ATCGTGAAGCCCGCCGAGCAAACCCCTCTATCGGCTCTCTTTTACGC
TCACTTGGCTAAGAAGGCCGGTATTCCTGATGGAGTAATCAACATTG
TAACTGGTTTTGGACGGACAGCCGGTGCGGCGATAAGCAATCACATG
GACATTGACATGGTAGTTTTACGGGGTCTACAGAAGTGGGACGCAT
TGTAATGCAGGCCGCAGCAACAAGCAATTTAAAACAAGTGTCGCTCG
AATTGGGCGGGAAATCACCTCTTATAATTTTTGATGATGTTGATTTA
GATACTGCTACTGATCTTGCTCTAACCGGTATCCTCCATAACAAGGG
AGAAATATGTGTTGCGGGCTCTCGTGTCTATGTTCAAGAAGGGATCT
ATGAAGAGTTCAAGAACAAGCTAGTGGCAAAGGCAAAGGCTTGGCCG
GTCGGCGACCCATTTGATCCGAATGTCCGTCACGGACCGCAAGTCGA
TAAGAAACAGTTTGAGAAGATACTTGCATACATCGAGCATGGAAAGA
GAGAAGGAGCCACGCTTTTGACTGGGGGCGAGCGTCTGGGCACCGAA
GGTTACTACATTCAGCCAACAATCTTCACAAATGTTAAGGAGGACAA
CATGATTGTGAAGGATGAGATTTTCGGCCCTATCATGTCGCTCATGA
AATTCAAGACCACGGAGGAGGTGATCAAGAGGGCCAATGACACGAGG
TATGGTCTAGCAGCAGGGGTTTTGACGAAGAACATAGATATGGCGAA
CACAGTCTCGAGGTCAATTCGAGCAGGCACCATCTGGATAAATTGCT
ACTTTGCATTCGACAATGACTGTCCTCTTGGCGGCTACAAGATGAGC |

TABLE 2-continued

Cell Signaling Gene Sequences

| SEQ ID NO | Sequence |
|---|---|
| | GGCTTTGGCAGAGATTTTGGTTTGGACGCTCTCCACAAATACCTACA<br>AGTCAAATCTGTTGTGACCCCCATTTACAAGTCTCCCTGGCTTTGAG<br>AGAAATTTAGGCAAGAAGGGGGATGGGGGGCATTTGCATCATCTGAT<br>GGCTCAAATTATCAAATTATGAATGATTAAGAGTGTATTTGTTTGGC<br>TGAAAGCATTTTCACTCGTGTAATTTGCTGAAAATGATCAATAAATG<br>AGAATCATTTATGGCCAAAAAAAAA |
| 8 | AAAATTTCGGAAGATCCCCAATCCGTTTCAAATTCTCTCGATCAAGG<br>ACCCCACGTTTTTCCTCCAAATCCAAAACCCTAATTCTCCGCATCTC<br>GATCCGTCGCAGATCTCTCCTCGCCGCCCTCCTCCCCGCCCTCCTCC<br>CCATGGCATCTCGCAGGCGCATGCTGCTCAAGGTCATCATCCTCGGC<br>GACAGCGGGGTCGGGAAGACGTCTCTCATGAACCAGTACGTCAACCG<br>CAAGTTCAGTAACCAGTACAAGGCGACCATTGGAGCTGATTTCTTGA<br>CGAAGGAAGTTCAGTTTGAAGATCGATTGTTCACATTGCAGATATGG<br>GATACTGCTGGGCAAGAAAGGTTCCAGAGTCTGGGTGTGGCTTTTTA<br>CCGAGGTGCAGACTGCTGCGTCCTTGTTTATGATGTGAATGTCATGA<br>AATCATTTGATAATCTTAACAACTGGAGGGAAGAGTTTCTACTTCAG<br>GCCAGCCCATCAGACCCTGAAAACTTTCCATTCGTCGTGTTGGGGAA<br>CAAGATAGATGTTGATGGTGGTAATAGTCGTGTGGTTTCTGAAAAGA<br>AAGCAAAGGCTTGGTGTGCTTCTAAGGGAAACATCCCTTATTTCGAG<br>ACATCTGCAAAAGAAGGATTCAACGTGGAGGCTGCATTTGAGTGTAT<br>AGCTAAAAATGCTTTGAAGAATGAACCTGAAGAAGAAATATACCTTC<br>CCGACACCATTGACGTCACTGGTGGAGGACGGCAGCAGAGATCTACT<br>GGCTGTGAATGTTGAAGAGAATTAATTGGCTACTCTTTCCTGGGAAT<br>GGAAATACAGTGGAACCGATTTATCGTGATTCATTGCTCAATAACTA<br>TTACGTAAGAGACTAATGTAGGCGACCAGATCAAACTCTCATCATGT<br>ATCATTAGTAGATCAAGGAAGACTGTTCCTTGGTCTTATCGGTTCCC<br>TCTTCTAATGTTAGTAGTTTACAAGTATAATTTGTTTGGACATGTAT<br>TCTTGGGTATGAGTTTGCTTTGAAGTAAAAAAAAAA |
| 9 | TCTCTCTCTCTTCAAATCAATCCACCCCCAAATCCTCCTCCTCCTCC<br>TCCGCCCCTCGCTTTCTCTCTAGATCGATCGGCCGGTCGATTTGA<br>TCGGAGCAGCTGCGGCGAGTCGGAGCGGGGCGATGGCGGTGCCGGAG<br>AACCTGGGCAGGGACCAGTACGTGTACCTGGCGAAGCTGGCCGAGCA<br>GGCGGAGCGGTACGAGGAGATGGTGGAGTTCATGCACAAGCTGGTCG<br>TCGGCTGGACGCCGGCCGCCGAGCTCACCGTCGAGGAGCGGAACCTC<br>CTCTCCGTGGCCTACAAGAACGTGATCGGCTCGCTCCGGGCGGCCTG<br>GCGCATCGTCTCCTCCATCGAGCAGAAGGAGGAGGGCCGGAAGAACG<br>AGGACCACGTCGTCCTCGTCAAGGAGTACAGATCCAAGGTCGAGAAC<br>GAGCTCTCCGACGTGTGCGCCAGCATCCTCCGCCTCCTCGACACGAA<br>TCTGGTCCCCTCGGCCGCCGCCAGCGAGTCCAAGGTGTTCTACCTGA<br>AGATGAAGGGGGATTACCACCGGTACCTGGCCGAGTTCAAGGTCGGC<br>GACGAGAGGAAGGCCGCCGCCGAGGATACCATGCTCGCTTACAAGGC<br>GGCTCAGGATATCGCTCAAGCAGATCTGGCTTCAACCCATCCAATAA<br>GGCTGGGTCTGGCACTCAACTTCTCTGTGTTCTATTATGAGATCCTT<br>AATCAGTCTGATAAAGCTTGCAGCATGGCCAAACAGGCATTTGAGGA<br>AGCAATTGCTGAGCTGGATACATTGGGTGAAGAATCATACAAGGACA<br>GCACTCTCATCATGCAGCTGCTAAGGGATAATTTCACCCTCTGGACT<br>TCTGATGTGCAGGACCAATTGGATGAGCCCTAGAAGATGCAGCGTAA<br>GCTCAACGGAAATTCGAAACTTTGTTCTGGGAGGAGGTGGGCTGTGA<br>AATGTCATTTGTCGGTACCGATTTAAAGCGTGCATCAGTGACATGTT<br>TCTCTTTTATTTTTAGATTATTAAATCCTTTTCCTGTTTCCAAAACG<br>AATTGGAAAACGCTCTTGGGTTTGTGAACGTGCTTCTCACTGCTTTA<br>GTGTTGGTTTTCACTGGATAAAAAAAAAA |
| 10 | CTCTCTCTCTCTCTCCGCCAAACGCTCTCGAAGAATCACCAGGGAAA<br>AAAAAAAAGAAAAAAAAGAGAAAGAAAAAAGATCAGGAAATCGAAA<br>AAACCGAAAGAGGAAGAAGAGAACCCCCAAATCCCCCCCTCCCCCA<br>GTTCCAGATCTAGAAGCCCCGGCGAGCAGCGAGCGAGCAGCAATGGC<br>GACGGCACCATCGGCGCGCGAGGAGAACGTGTACATGGCGAAGCTGG<br>CGGAGCAGGCGGAGCGCTACGAGGAGATGGTGGAGTTCATGGAGAAG<br>GTCGCCGCCGCCGCCGCCGCCGACGCCGAGGAGCTCACCATCGA<br>GGAGCGCAACCTCCTCTCCGTCGCCTACAAGAACGTCATCGGCGCCC<br>GCCGCGCCTCCTGGCGCATCATCTCCTCCATCGAGCAGAAGGAGGAG<br>AGCCGCGGCAACGAGGACCACGTCGCCGCCATCCGCGACTACCGCTC<br>CAAGATCGAGTCCGAGCTCTCCGGCATCTGCGCCGGCATCCTCAAGC<br>TCCTCGACTCCGCCTCATCCCCGCCGCCGCCTCCGGCGACTCCAAG<br>GTCTTCTACCTCAAGATGAAGGGCGACTACCACCGGTACCTCGCCGA<br>GTTCAAGACCGGCGCCGAGCGCAAGGAGGCCGCCGAGAGCACCCTCA<br>CCGCCTACAAGGCCGCTCAGGACATTGCCAACACGGAGCTTGCTCCG<br>ACTCACCCAATCCGGCTCGGACTAGCCCTCAACTTTTCTGTTTTCTA<br>CTATGAGATTCTGAATTCTCCTGACCGTGCTTGCAGTTTGGCCAAGC<br>AGGCTTTTGATGAAGCAATTGCTGAGTTGGATACACTTGGAGAGGAG |

TABLE 2-continued

Cell Signaling Gene Sequences

| SEQ ID NO | Sequence |
|---|---|
| | TCTTACAAAGACAGCACTTTGATTATGCAACTTCTTCGCGACAACCT<br>CACCTTGTGGACTTCCGACATGCAGGAAGACGGTGCAGACGAGATTA<br>AAGAAGCACCGAAGGCTGATGAACAGCAGTGAGGTCTTGACTATTGC<br>TCGCTGTCAAATTTCTCCATTCAATGTTTTACTTGGAGAAGGTGCT<br>TGTTGCTGATTTCTCTTTTATTCCGAAGTTGGAGGCATCATCGTCTC<br>TTTTTATTTGTTTCTGACTTTAGTTTGTCTCATCAATCTCCTCATGT<br>GCTATCAATTGTGCCTTATTTTCTTGGAGGCATGGAGCTTCAAATT<br>CTGCATTGAGTGTAGCAGATCCCTTCTATTAGATTATTCATATGACT<br>ATGTGACTGATATATCTTCTTTCTTTGTCAACAAGATATTTGATTC<br>GATGTGCTAAAAAAAAAAAAAAA |
| 11 | GCTCTCTCTCCCTCCCTCCCTCCCTCTCTCTCTCTCTCTCTCTCT<br>CTCTCTAAACCCGACGCGATTTTCGAATCCGACCTCCCTCGACAACC<br>CTCTCCGATGGCCGCCGCCGCACCGCCGCCGTCCTCGCCGCGCGAGG<br>AGTACGTGTACATGGCGAAGCTGGCCGAGCAGGCGGAGCGCTACGAG<br>GAGATGGTGGAGTTCATGGAGAAGGTGTCGGCCGCCGCCGCCGACGC<br>CGAGGAGCTCACCGTCGAGGAGCGCAACCTCCTGTCGGTCGCCTACA<br>AGAACGTGATCGGGGCCCGCCGCGCCTCCTGGCGCATCATCTCCTCC<br>ATCGAGCAGAAGGAGGAGAGCCGCGGCAACGAGGACCACGTGGCCGC<br>GATCCGCGACTACCGCGCCAAGATCGAGGCCGAGCTCTCCAAGATCT<br>GCGACGGCATCCTCGGCCTCCTCGACACCCGCCTCATCCCCGCCGCC<br>TCCGTCGGCGACTCCAAGGTCTTCTACCTCAAGATGAAGGGGGATTA<br>CCACCGCTACTTGGCCGAGTTCAAAACCGGCACCGAGCGCAAGGAAG<br>CCGCCGAGAGCACCCTCACCGCCTACAAAGCCGCTCAGGATATTGCC<br>AACTCTGAACTGGCTCCTACTCACCCAATTCGGCTTGGGCTGGCTTT<br>GAACTTCTCTGTTTTCTACTATGAGATTCTCAACTCCCCCGACCGTG<br>CTTGTGGTCTCGCTAAACAAGCCTTTGATGAAGCAATTGCTGAGTTG<br>GACACTCTTGGTGAGGAATCCTACAAGGACAGCACTTTGATCATGCA<br>GCTTCTCAGAGATAACCTGACCTTGTGGACATCCGACATGCAGGATG<br>ATGGAGTGGATGAGATCAAAGAAACAGCCAAGGCTGATGAGCAATAG<br>TGATGTCTCAGCTGCTCATCAATATCCGTATAGAAGCTACCCTCTTA<br>TCTGTTTTTAACTGGGGAAGATTGCTGGCTACTGATTCATGTGCAA<br>TTCTGGGTTTTAGGCTCGTTGTCTCTATAACAGAATTCTGGTGTTGC<br>TTGTCTTATCGAAGTCTTATGTATTTCCAAATCACTCTTATTTCTCT<br>TGGATTCTTAATGCTTCAATATCTCAATTGAACACGATAAAAGGCCT<br>CCATGTCTATGCAGATTGTTGCCTACTTTAAAAAAAAAA |
| 12 | CTCTCTCTCTCTCTCTAATTTCCTTCACCTCAAACCCCCCCCCCCCC<br>CAAATCCCACCGGCTCCCGGCAGCAACCGCCGATCGCCGATCGCCGC<br>CGCCGCCGCGATGAAGAAGGGGGGCTTAAACCCCATCCTCAACCTCA<br>AGCTCTCCCTCCCTCCTCCCGATGAGGACTCCATCGCCAAGTTCCTG<br>ACGCAGAGCGGCACGTTCGTGGATGGCGATCTGCTCGTCAACAGGGA<br>CGGGGTTCGGGTCGTGCAGCAGACCGAAGTCGAAGTGCCACCCCTTA<br>TCAAGCCAACAGACAACCAGTTGAGTTTAGCGGACATAGACACAATT<br>AAAGTTATTGGAAAGGGGAATGGTGGAATAGTCCAATTGGTCCAACA<br>CAAATGGACTGGGCAGTTTTTCGCATTGAAGGTCATCCAAATGAAGG<br>TTGAGGAGTCTGCAAGAAAGCAGATAGCACAGGAACTCAAAATTAAT<br>CAATCTTCGCAGTGTCCATATGTTGTGGTCTGCTACCAATCTTTCTA<br>TGATAATGGTACCGTTTCTATTATATTAGAGTATATGGATGGAGGGT<br>CGCTGGCGGATTTTCTGAGAAAGTTAAACTATTCCAGAGCCAAATC<br>TTGCGGTCATTTGTAAGCAGGTGCTCAAGGGTTTGTTGTATCTGCAT<br>CATGAGAAGCACATAATACATCGAGATCTGAAGCCTTCTAATCTGTT<br>GATAAATCATAGAGGAGAAGTCAAGATTACTGATTTTGGAGTGAGTG<br>CTATAATGGCTAGCACATCTGGACAAGCTAATACCTTTGTCGGCACA<br>TATAACTATATGTCTCCTGAGAGAATCATTGGAAACAATTATGGTTA<br>CAAAAGTGATATTTGGAGCCTGGGCTTAGTATTGCTAGAGTGTGCAA<br>CTGGGAAGTTCCCATATACACCGCCTGATCAACAAGAAGGATGGACC<br>AATTTCTATGAGCTCATGGAAGCCATTGTTGATCACCCACCGCCTTC<br>AGCAGCTTCTGATCAATTCTCTAGCGAGTTCTGCTCATTTATCTCTG<br>CCTGTGTACAGCAGGACCCAAAGAAAAGATGGTCTGCGAATGAACTT<br>ATGGGTCATCCTTTCATCAGCATGTATGAGGACTTGAATGTTGATCT<br>TGCTTCCTACTTCACTAATGCAGGCTCCCCGCTTGCAACCTTTTGAA<br>ACTCCACTGTGGTTCCAGCAACCGGAGATCTTTGGCTCCCTGGGAGC<br>TTAGAGAGCAGTTTCAAGAAAAACACCTGCTCAGGATTTTAATTTAT<br>TATGAAAGTGGATAACTTTTGGAGCTGATAACTGTCTGCCTCGAGCG<br>GAGTGTAGTGGAGTGGAGTGAAGTGTTGGCAGTTAAGACGATTTCAA<br>GGGCGTGATTACTTTGAGCGTCGAAGGACAGCTGATGTAAATTCGAA<br>ATTTCTTTCTTATTGCAAGG |
| 13 | CCGGCATTGCCCCGACCCGACCCGGCACGGATGGAGGACGACAGAGCG<br>GGGGGAGGAGTACCTCTTCAAGATCGTGCTGATCGGCGACTCCGCCG<br>TCGGGAAGTCCAACCTCCTCTCCCGGTTCGCGCTCGACGAGTTCGAC<br>ATCAACACCAAGGCCACCATCGGGGTCGAGTTCCAGACCCAGGTCGT |

TABLE 2-continued

Cell Signaling Gene Sequences

| SEQ ID NO | Sequence |
|---|---|
| | GGAGATCGACGGCAAGGAGGTGAAGGCCCAGATCTGGGACACCGCCG<br>GCCAGGAGCGCTTCCGCGCCGTCACCTCCGCCTACTACCGCGGCGCC<br>GTCGGCGCCCTCATCGTCTACGACATCACCCGCCGCACCACCTTCGA<br>GAGCGTCAAGCGGTGGCTCGACGAGCTCGATACTCACTGTGATACCG<br>CTGTCGCAAGAATGCTTGTTGGGAACAAGTGTGATTTAAACAATATC<br>AGAGAGGTGAGCACCGAGGAGGGCAAAGCCCTTGCAGAAGCAGAAGG<br>GCTATTCTTTATGGAGACCTCCGCCCTCGATTCCACGAATGTTCAGA<br>TATCGTTCGAGATTGTTATCCGCGAGATATACAAGAATATCAGCAGG<br>AAGGTCCTCAACTCCGATTCATACAAGGCGGAATTGTCCGTAAATCG<br>AGTGACCCTCGCCAAAAACGGTGCGGACTCGTCAGGTCGGAGTTTCT<br>ACTCGTGCTGCGCTAGATGATGTCCGATCCTTCATGTACGCTCCATC<br>AATTTTTTGGAGTCTCTTGTACTGTTTTATTTCATCAAATTTTTGGA<br>AGTGTCTTGCACTGTCTTATTTTATCAATTTGTATCCTAATACGTGG<br>CCAATGAACTTTACGGTTTTCTTCAAAAAAAAAA |
| 14 | CGAGCACAGTCGGTGGTCAGACCACTTTCCCACGTCTTTTTCTCTTT<br>CCTCCTCCTCCTCTTCTCCTTCAATCCCCTCCGCATTCCAAGCGTCC<br>GCTGCATTGGATCGACCTCTGACGGAACCTGCAGAAGAAGCGAGAGA<br>CAGAAGAGCGAGAAAGCAGAGGGAGATGTCGTCGTCGGACGAGGAGG<br>GAGGGGAGGAGTACCTGTTCAAGATCGTCATCATCGGGGACTCGGCG<br>GTGGGGAAGTCGAACCTGCTGTCCCGGTACGCCCGGAACGAGTTCAA<br>CCCCCACTCCAAGGCCACCATCGGGGTGGAGTTCCAGACCCAGTCCA<br>TGGACATCGACGGCAAGGAGGTCAAGGCCCAGATTTGGGACACCGCC<br>GGCCAGGAACGCTTCCGCGCCGTCACCTCCGCCTACTACCGCGGTGC<br>CGTCGGCGCCCTCGTCGTCTACGACATCACCCGCCGCTCCACCTTCG<br>ACAGCGTCTCCCGCTGGCTCGACGAGCTCAAGACTCACTCAGACACA<br>ACAGTTGCAAGGATGCTTGTTGGGAACAAATGTGACCTGGAGAGTAT<br>TAGGGATGTGACGGTTGAGGAGGGGAAGAGTTTAGCGGAATCAGAAG<br>GGTTGTTCTTTATGGAGACTTCCGCTTTGGATGCCACAAATGTGAAG<br>ACAGCCTTCGAGATCGTGATAAAAGAAATATATAACAATGTGAGCAG<br>GAAGGTTCTAAATTCAGATGCTTATAAAGCAGAGCTCTCTGTTAACA<br>GGGTAACCTTGGCTGGTAATGGGGCCGATGGATCAAAGCGGAGTCAG<br>AGCTTTTCTTGCTGTTCCAGGTGATACTGTAGAGGTGTAATTCTTTC<br>AAGTCCGATGATGAAAACTTCATTGTCGATTCTATTGGTTGAGCTGT<br>CTGTTTGTTTGGTTTTTGCTTGTTTTTTCTTATCAGGGGTTGTTTAAA<br>ATGCTGTTATAGCAAATTTTATTCAAGAATATTAACCTATCGATTTC<br>TTCTAGTTCTAGATATATGTAATAGCAAAGAATTATGTGGACCAAAA<br>AAAAAA |
| 15 | GAAAGATCGAGAAACCTGCTGCGGCTGCTAAGTGGGAGGACTAGCAG<br>AGACAAACCAATTTCCACACGTCTCTCTCTCTCTGCTCTCAGACC<br>AGACGGCGACAAAACTGAGCTCCGGCTCGGAGCGACAGCAAAACCCA<br>AGCCACACAGAAGAGAGAGATACACAGAATAGCAATGGCGCTGGTTC<br>CATCCGATCCCATCAACAACGGCCAGTCCCTCCCCCTCATCGCCGAG<br>GTCAACATGTCCTCCGACTCCTCCTCCGCCGCCGCCGTCGTCCGCGC<br>CACCGTCGTCCAGGCCTCCACCGTCTTCTACGACACGCCCGCCACTC<br>TGGATAAGGCGGAGAGGCTGCTGGCCGAGGCGGCTTCGTACGGGTCT<br>CAGCTGGTCGTCTTCCCCGAAGCCTTCGTCGGCGGTTACCCCCGCGG<br>CTCCACCTTCGGCGTCAGCATCGGCAATCGTACGGCGAAAGGCAAGG<br>AGGAGTTCCGCAAGTATCACGCCTCCGCCATCGATGTTCCAGGCCCT<br>GAAGTTGATCGCTTAGCAGCGATGGCTGGAAAATATAAAGTTTTCCT<br>AGTGATGGGGGTGATAGAGAGAGATGGATATACATTGTATTGCACAA<br>TCCTGTTTTTTGATCCTCAAGGTCATTACCTTGGGAAGCACCGTAAA<br>GTCATGCCAACGGCTCTGGAGCGTGTCATCTGGGGATTTGGTGATGG<br>GTCGACCATTCCGGTGTTTGATACGCCGATTGGGAAAATTGGTGCGG<br>CCATTTGCTGGGAAAATAGAATGCCACTTCTGAGGACAGCAATGTAT<br>GCTAAAGGTGTTGAAATATATTGTGCGCCGACAGCTGATGCGAGGGA<br>CATTTGGCAAGCATCTATGACACATATTGCTCTTGAGGGTGGATGTT<br>TTGTTTTATCAGCCAACCAATTTTGTCGTCGGAAAGACTACCCGCCT<br>CCACCAGAGTATGTTTTTGCAGGAACAGATGACGATCTTAACCCAGA<br>TTCTGTCGTATGTGCTGGAGGCAGTGTAATTATATCTCCATCAGGAA<br>ATGTTTTGGCCGGACCCAATTATGATGGCGAGGCACTCATCTCAGCT<br>GACCTTGACCTTGGAGAAATAGCGCGGGCCAAGTTTGATTTTGATGT<br>GGTTGGGCATTATTCGAGGCCTGAGGTGCTTAGCCTGATCGTGAGGG<br>ACCATCCGAGCAACCCAGTTACCTTTGCATCGACATCCGGGAAGCCT<br>GAAGGCCCTTACAAATAGGTTATGTTTTCTTTCACGGAGCCAGGTCT<br>GAATCATGGCAAATAACGGCAAGCAAATGTTGGTCCCAGTGGGAAGC<br>TTTTGATTGTTTGTTTCAACTTTTTGGACTCCTGATTGTTTGTTCAA<br>CTTTTTCGACTTCATGAGCTATTGTAAATTCTGATTGCAAGCAACAT<br>AGTTCATGAATACTTCCTGCTTGATAGTTGAGAAAGCGATGTTATAT<br>TTCAGTTGCACAGTAAACATGTCTGTATCCTGTGCAGTAGGACTCTT<br>GTAACTAGTCTGTATCTTGGCAATGAAATAAGAACATTAGTGACTGT<br>TCTCGTGAATTAAAAAAAAAA |

TABLE 2-continued

Cell Signaling Gene Sequences

| SEQ ID NO | Sequence |
|---|---|
| 16 | TCTCTCTCTACACACTCTCTCTCTCTACATTCTTTCTCTCTCTTCAC<br>TTTCTCTCTCTACTGTGTCCCTGCCCAAATTGCCATTTCTGAAGTGT<br>GTCAGCTTCGCCCTTTGGGTGGAGTTAAACAGAGATCACAATAATCT<br>CCTTCATTATTGTCATCTTGACATCGACTCCTCTCTCCCTCTCTCTC<br>TCTCTCCATCCATCTCCTCCTCGTTCTCTCTCTATATTACCCATTTC<br>GCCTCCGTCCTTCCGTTTCTCTCTCCTCCTCTCCTTCCCCCCCCTTT<br>TCCCCCCAACCTCCAGTTCATTCGGCATCACTCACTCCCAATCTCAA<br>TCTCCCGGACCCATGTATCAATCTGAATCTTTGCTCTCAATTCCCAA<br>TCCCCGGTCGAATCTTTGACTACCCATCTTCGAATCCTCTTCTGGGT<br>CGCCCTCTATCTCCCTCCCCACGTCCCCCGCCTCCGCCGCCGGAGCG<br>GCCGGGGTTCTGCAGCCGAGGCCGCCGCGACCGGCCGCATTGAGCCC<br>GGAGCCGACCGCCGTCCGCCGTCCGGGACCGATCCGGAGCGCAAAGT<br>CATGAGCTTGGCGGGGTCTTGGTGATTCCCCGGGAGGTGGGTCGGTC<br>ATGGATCCGAGCAAATCGCGCGACTCGGCGGAGTCGACCCGGGTGAT<br>ACAGTTCCCGAACGACGTGCTGGAGCGGATTCTGTCCCTCATAGACT<br>CGCACCGGGACCGGAACGCCGTCTCCCTCGTCTCCAAGGCGTGGTAC<br>AACGCGGAGCGGTGGACGCGGCGGCACGTCTTCATCGGCAACTGCTA<br>CGCGGTGTCGCCGCAGATCGTGGCCCGCCGGTTCCCCAACATCCGCA<br>GCGTCATGCTCAAGGGGAAGCCCCGGTTCTCGGACTTCAACCTGGTG<br>CCGCCCAACTGGGGTGCTGACGTACACGGGTGGCTCGCGGTCTTCGC<br>GGATCAGTACCCGCAGCTCGAGGAGCTGAGGCTCAAGCGGATGACCG<br>TGACGGACGAGAGCTTGAAGTTCTTGGCTCGCAAGTTCCATAATTTC<br>AGGGTGCTCTCGCTCCTGAGCTGCGATGGGTTCAGCACCGATGGTCT<br>CGAGGCAATCGCAACCGACTGCAGACATTTGACTGAGCTGGATATAC<br>AAGAGAATGGGATTGATGATATCAGTGGCAACTGGTTGAGTTGCTTC<br>CCTGAAACTTCACATCTATGGAGGTGCTGAACTTTGCAAGTCTAAGT<br>AGTGATGTGAATTTTGACGCTCTTGAGAGGCTTGTAAGTCAGTGCAA<br>GTCACTGAAGATTTTGAAGGTTAATAAAAGTATTACGCTAGAACAAT<br>TACAGAGGCTGCTTGTCCGTGCTCCTCAGTTGACCGAGCTTGGTACT<br>GGTTCGTTTTTACAAGAGCTTACTGCTCACCAGTCTGAGGAGCTTGA<br>AAGAGCTTTCATTGGTTGCAAGTATCTGCATGCACTCTCCGGCTTGT<br>GGGAAGCTACGACACTATATCTACCTGTTCTTTACCCAGCCTGTACA<br>AATTTGACTTTTCTGAATTTAAGTTATGCTGCTTTGCAAAGTGAAGA<br>GCTTGCCAAGCTTGTTGCCCACTGTCCACGTCTTCAGCGTCTCTGGG<br>TACTTGACACTGTTGAAGATGTAGGACTTGAGGCTGTTGCCTCGAGT<br>TGTCCCCTTTTAGAGGAGCTTCGAGTCTTCCCAGCTGATCCTTATGA<br>CCAGGACATTAATCGTGGTGTGACTGAATCGGGGTTTCTTGCTGTGT<br>CGCTCGGCTGCCGCAAGCTCCACTATGTCCTCTACTTTTGCCGTCAG<br>ATGACAAATGCTGCTGTAGCCAGAATTGTGCAGAACTGCCCTGGTTT<br>TACCCACTTTCGTCTTTGCATAATGAAGCCGGGGCAACCTGATTACC<br>TAACAAATGAACCTATGGATGAGGGTTTTGGTGCAGTTGTGAAGACT<br>TGCACAAATCTCCGAAGGCTTGGCGTTTCTGGTCTTTTGACTGACTT<br>AACGTTCGAGTATATTGGAAGATATGCGAAGAACTTGGAAACGCTTT<br>CTGTGGCTTTTGCTGGCGGCAGCGATCTCGGGATGAAGAGTATACTG<br>GTTGGTTGCCCAAAGTTGAGGAAACTTGAAATAAGGGATTGTCCATT<br>TGGTAATGAAGCTCTTCTTTCGGGCTTGGAGAAATATGAGTCAATGA<br>GATCTTTGTGGATGTCTGCTTGCAAAGTGACGCTACATGGTTGTAAG<br>ACATTGGCTACGCAAAGGCCACGGTTGAATGTTGAGGTAATGAAGGA<br>TGAGGAGATCGATGATGGCCAGTCTTATAAGGTTTATGTTTACCGTA<br>CTGTTGCTGGACCAAGGACAGATGCTCCATCTTTTGTCCATACTCTT<br>TGAAGTTGATAATTAGAGGGAGCTGGTGCCAGGATTCTGGAACTTTC<br>AAGGGCAGCCTGTGTTCTGCGAAGTCAGCCCTTGTGCTAATGCTGGA<br>GCCCGGGGAGCGGAACAGAACTCATGTTCCTGTTACCTCAACTGTTT<br>TACAAGGCCTCCACCTGTGGTGCTCAATTTGTTGTAGCAAGGCACCT<br>TGAAATTTAACTTCTTGTAGACTCGTGAAATTTCCTTCCTTTGTCAT<br>ATTTTCTTCTGAGTGTTTTTAACTC |
| 17 | GGAGAGATAGAGAGAGCGAGAGGAGAGAGACGGCGATGGAGGATGAG<br>GAAGAAGAGACGACGACGACGACGATGATGCGCGGACCATGCCGATC<br>CAGAGACGGCGGCGCAGCAGCGGCGGCGGCGGCGGAGGCGGCGGGGC<br>CTTCCACCGTGTGTTGACTTCTCTCCCGGCCCTCCCGACTCCGCC<br>TTCGGGCTCGGCGGACTTGATTAGTCGGGCATGTGAAAAAGAATCTT<br>TGACTGCTCAGATTGTTGAACAACGTGATGGAGTCCTGCAACTGCGT<br>TGAGCCACAGTGGCCAGCTGATGAGCTTTTGATGAAGTATCAGTACC<br>TCTCAGATTCTTTATTGCTCTGGCGTACTTTTCCATCCCTCTAGAA<br>CTCATCTACTTTGTCAAGAAATCTGCTGTATTTCCCTATAGATGGGT<br>TCTTGTTCAGTTTGGTGCCTTCATAGTTCTGTGCGGAGCAACCCACC<br>TGATCAACTTATGGACATTTGCCATACACTCAAGAACTGTAGCATAT<br>GTTATGACCATTGCAAAGGTTTTAACTGCTGCGGTATCATGTATTAC<br>AGCTCTCATGCTTGTGCATATCATCCCCGATCTACTTAGTGTGAAAA<br>CCAGGGAACTATTTCTGAAAAACAAGGCTGCAGAACTTGACAGGGAA<br>ATGGGCTTAATTCGTACTCAGGAGGAAACTGGCAGACATGTCAGGAT |

TABLE 2-continued

Cell Signaling Gene Sequences

| SEQ ID NO | Sequence |
|---|---|
|  | GCTAACGCACGAAATCAGAAGCACTCTTGATCGACATACTATTTTGA<br>AAACTACTCTGATTGAACTGGGCAGAACTTTGGGATTGGAAGAGTGT<br>GCCCTGTGGATGCCAACACGAAGTGGCTTGGAGCTTCAGCTATCCTA<br>CACTCTCCGTCAGCAGCAGAATCCAGTTGGATACACAGTACCCATTC<br>ATCTTCCTGTAATCAATCGAGTGTTTAGTAGCAATCGTGCGTTGAAG<br>ATATCACCCAATTCACCCGTTGCTAGAATACGTCCTCTTGCGGGGAA<br>ATACATTCCCGGTGAGGTTGTCGCTGTGCGGGTTCCTCTGCTGCATC<br>TCTCTAATTTCCAGATAAATGACTGGCCTGAGCTTTCAACGAAACGG<br>TATGCTTTAATGGTGTTGATGCTTCCATCCGACAGTGCTAGGCAGTG<br>GCATGTCCATGAACTGGAGCTCGTTGAAGTGGTAGCTGATCAGGTTG<br>CAGTTGCTCTCTCCCATGCTGCAATACTAGAAGAGTCTATGCGGGCA<br>AGGGATCTTCTCATGGAGCAAAATGTTGCACTTGATCTGGCCAGAAG<br>AGAAGCGGAAACAGCTATTCGTGCTCGCAATGATTTTTTGGCTGTTA<br>TGAACCATGAAATGAGAACTCCCATGCATGCAATTATTGCCCTTTCT<br>TCCTTACTGCAGGAAACTGAACTGACCCCTGAGCAGCGTCTAATGGT<br>TGAAACGATAATGAAGAGCAGTAATCTTTTGGCTACTTTGATAAATG<br>ATGTACTAGATCTTTCGAGGCTTGAAGATGGAAGCTTTCAACTTAAC<br>ATCGCCACGTTTAATCTTCATGCTGTGTTTAGAGAGGTCCTTAATTT<br>GATTAAACCGGTGGCATCTGTGAAGAAACTGCTCATCACATTGAATT<br>TAGCCCCAGATTTGCCTGAGTATGCTGTTGGGGATGAAAACGCCTCA<br>TGCAAGTCATTTTAAATGTTGTTGGTAATGCAGTTAAATTTTCTAAA<br>GAAGGTGGCATTTCGATAACCGCCTTTGTGGCTAAAGCAGAGTATTT<br>AAGAGAAGCCAGAACTCCCGAATTTCTTCCATTGCCAAGTGATAATC<br>ACTTCTATTTACGTGTACAGGTGAGAGATTCTGGATCAGGTGTTAAC<br>CCTCAAGATATTCCCAAGTTATTCACAAAATTTGCACATAACCAATC<br>ATTAGCAACCAGAAATTCTGGTGGGAGTGGACTAGGTCTTGCAATTT<br>GTAAAAGGTTTGTAACTCTCATGGATGGACACATATGGATTGAAAGC<br>GAAGGCATTGGCAAAGGATGTACTGCCACGTTTATTGTAAGGCTGGG<br>AATCCCAGAGAAGTTGAATGAATCTAAGTTCCCTGTATTACCCAGAG<br>GGTCATCAAATCATGTCCTGGCCAATTTTTCTGGGCTCAAAGTGCTT<br>GTTATGGATGATAATGGTGTTGGCAGGGCAGCGACCAAGGGACTTCT<br>CCTACATCTGGGATGTGATGTGACAACCGTAAGCTCGGGGGATGAGT<br>TGTTGCATGCTGTCTCTCAGGAACACAAGGTAGTTCTTATGGATATT<br>TGCACGCCTGGTATAGACAGTTACGAAGTTGCCGTCCAGATACACAG<br>GTTGTATTCACAACATCATGAGAGGCCACTCTTAGTGGCAATCACTG<br>GAAGCACTGACAAGGTAACCAAAGAGAATTGCATGAGGGTTGGGATG<br>GATGGTGTTATCCAGAAACCTGTGTCGCTTGATAAAATGAGAAACGT<br>ACTGTCTGAGCTACTGGAATGTGGACATCAAATGTCTAGTTTGGCCC<br>GTGTTTGAGAAGAATGGAGAAAATAAGACTGCGATAAAGTTTCTTGC<br>GGCAATGATTTGTAAATACTGCATGCAGTGGAACATTGGAGGGTTAT<br>CAAGCAATGCTACAACAACCCCATGTAATACGAGACTCATACCGATC<br>ATTTTTATCCAAGAATGACCAAGGTCATCAGATGATTGAACAAGCCG<br>AAGCCCCATAGTGGAGCTGCTAGTAACTTCACGGGATGATGACAAGT<br>CTTATGTGTCGTCGACAAAGTTGTGATGTCGTTGCAATTGTAAGATA<br>TTATGGTCCCATCAATGATATCTCTTTGTTTGAAAAAAAAAA |
| 18 | GAAAAGCTTCTGTACATGCGCAATCCCAAAGGAAGCCCTCTGAACAT<br>CCGTTGATCCCTGGCGGAAAAAAGAGGCAGCACCCATTGATCACCAG<br>GGAGAAAGAGAGAGGGTTGCTTACGGATTCTCCGAATTCGCAAGA<br>ATGGCTTCTCGGAGACGCATGCTTCTCAAGGTCATAATCCTTGGTGA<br>CAGCGGGGTTGGAAAGACATCTTTGATGAATCAATATGTGAACCGAA<br>AGTTCAGTAATCAGTACAAAGCAACCATCGGGGCAGATTTCCTTACC<br>AAGGAAGTCCAGTTTGGGATAGACTTTTCACATTGCAGATATGGGA<br>TACAGCGGGGCAGGAACGGTTCCAAAGTCTCGGTGTTGCCTTTTACC<br>GTGGAGCTGACTGTTGTGTTCTTGTATATGATGTGAATGTGATGAAA<br>TCGTTTGACAACCTTAACCACTGGAGAGAGGAGTTTCTCATTCAGGC<br>CAGCCCTTCTGACCCTGAGAACTTCCCATTTGTTGTGTTGGGAAACA<br>AGATTGACATTGATGGTGGCAACAGTCGAGTGGTATCTGAGAAGAAA<br>GCGAAAGCATGGTGTGCCTCAAAGGGAAACATTTCTTACTTCGAAAC<br>TTCTGCAAAGGAAGGTTTTAATGTTGAAGCAGCTTTCCAATGTATAG<br>CCAAGAATGCCCTTAAGAATGAGCCTGAAGAAGAACTCTACCTTCCC<br>GATACTATTGATGTGGCTGGTGGACAGCAGCAGCGTTCTTCGGGCTG<br>TGAATGTTGAAGAGTATATGACTTTAAATTTGCTGGTCCCTCGAGAA<br>AAGACTCGCAAAAGACGGCCATCATTTTACTTCTGCCGACTGTGAAT<br>CGCCAGGGCACTACCGGTTGTTGAGAGTGCCATGTATATCATTAGCA<br>ATGTTCATCAGTTCAGCACAATATTTGTGGTTTCATCGTTCCAAAAT<br>CGTGCGTTGTGAAATTGGTTGTGTATAATCTCTAGAATCCAAAGGCT<br>TACGGGTCATGCAATCCTTTCTAATTTGATTACTCAGATGTCCAAGC<br>TGTACACTTAATTTGCTCTCAAAAAAAAAA |
| 19 | GGTCGAAGCTGAAAATCTGACAAAATCCTCTCCCCGCGGCCGTTTCC<br>GTTCTTGAGCTTCGATCCGCAGGGAAGGGGAGCTCCGAGCAATGGCG<br>GGCGGCTACAGGGCGGACGACGACTACGACTACTTGTTCAAGGTGGT |

TABLE 2-continued

Cell Signaling Gene Sequences

| SEQ ID NO | Sequence |
|---|---|
|  | GCTGATCGGCGACTCCGGCGTCGGCAAATCCAACCTCCTGTCCAGAT<br>TCACGCGGAACGAGTTCAGCCTGGAGTCCAAGTCCACCATCGGGGTC<br>GAGTTCGCCACCAGGAGCATCCGCGTCGACGACAAGGTCGTCAAGGC<br>CCAGATTTGGGACACCGCCGGCCAAGAGAGATATCGTGCAATCACAA<br>GTGCCTATTACAGAGGAGCAGTTGGTGCATTGCTTGTTTATGACGTT<br>ACGAGACATGTCACTTTTGAGAATGTCGAAAGATGGTTGAAGGAGCT<br>GCGGGACCACACAGACTCTAATATCGTGATAATGCTGGTAGGAAACA<br>AAGCAGATCTGAGGCACTTGCGTGCCGTGTCTACGGAGGATGCCAAG<br>GCCTTTGCAGAAAGAGAGAACACTTACTTCATGGAGACTTCCGCTCT<br>TGAATCTATGAATGTAGAGAATTCATTCACCGAAGTGCTCACACAAA<br>TATACCACGTGGTGAGTCGAAAAGCACTTGATGTTGGGGAAGATCCG<br>GCAGCACCTCCCAAGGGACAAACTATCAGTGTCGGTTCAAAGGATGA<br>TGTTTCCGCAGTCAAGAAAGTGGGCTGTTGCTCCGCTTGAAGTTAAG<br>AGTAACAGAATGAAGATTTTGGGGGAAGTCTTTATTCAATCCTAATC<br>TGCTGCCCGGAGAATTGGAAGATGTTACGCGGGAATTGCAGACCTTC<br>TTTACAACCTGTCACCATCATCTCCATGCATGGCGATGCTTAAGCTT<br>TTGCCGGATCAATTTAAGTTTGAAGTCCAAGGAAACCGGATGTTAGG<br>GCTTCGTGTATTTCATTTGTTTCATTTCCAGATGCTTAATTTTCTAT<br>TCCCATCCCGTGTTGATTTGTTTGTTGGGTTCTCTAGGTTTTTGAGC<br>TGAATTGGTCATGTCACACAGGGAACTGTCTTCGGGCGAGTTTAATC<br>ATGTATCTGATTTACGATCGGTGTTGTGAACGTCGGA |
| 20 | CACCAACCATCCCGGGCGGGCGGCCTCGACTCCTTCTTGTTCCGTGC<br>AGTTTTCATAGACTACTTCCATTAACGAGAATCCTTCCTCCATCGGC<br>GTCTCCTTCTCCTTGTGCTTCTTGTTCTTGGTGAGACTCTTGGAAAA<br>GGGATGGTGGATTCGTTCGACGAAGAGTGCGATTACTTGTTCAAGGC<br>CGTCTTGACCGGGGACTCTGCCGTCGGGAAATCGAATCTCCTATCGA<br>GGTTCGCGAGGAAGGAGTTCCAGTTGGATTCGAAACCCACGATAGGC<br>GTCGAATTCGCATACAGGAACGTCAAGGTCGCCGACAAGCTCATCAA<br>AGCCCAAATATGGGACACTGCAGGGCAAGAAAGATTTCGAGCCATCA<br>CCAGTTCATACTATCGCGGAGCACTGGGGGCGCTGCTGGTTTACGAC<br>ATCACTCGGCGAGTGACGTTCGAGAACGTGAAGAAATGGCTGCGCGA<br>GCTCAGAGACTTTGGGAATCCCGACATGGTGGTGGTCCTGGTCGGGA<br>ATAAGTCCGATCTGGGCAGCTCTAGAGAAGTGGACCTGGAAGAAGGG<br>AAGGACTTTGCGGAGGCAGAGAATCTGTGCTTCATGGAAACTTCTGC<br>TCTGGAGAATCTAAATGTCGAGGAAGCATTCTTGGAGATGATCACCA<br>GAATCCATGAGATCACAAGCCAGAAGAGCTTAGAAGCCAAGAACAAT<br>GAAATAACCAGTAGCCTTCACGGTCCTAAGCAGGTCATTCAGATTGA<br>TGAGGTCACTGCTACTAAAAAGCCATACTGTTGCTCAAGTTAATCCC<br>AACCGTTGGGGATTTTTTGACGAGTCAGTACCAAATTTATAGTTGC<br>CTACTGACCACATCTTGATTTTTTCCCCTGAATTCAAGTCCAATCA<br>GCTTCCTCTTTAAAAAAAAAA |
| 21 | GGTAATTGCCCAAATCAGATTCCTAGATTCTAGCCAACTCGACAACC<br>GTCTCCACCCTTTCTTTCTTCCCCTCAAATTTCAAATCAGTCCAAAA<br>AAACTCAAGACTGCTGCTGCTGCCGATTGATTCGCCATCTCCTTCCC<br>ACCTTCCCTCCTTCCTCTCCAATCTCTCGAAGCTCCGTTGCTTTCAT<br>GGCCGGGTACAAAGCCGACGAGGAGTACGACTACCTGTTCAAGCTGG<br>TCCTGATCGGCGACTCCGGCGTCGGCAAGTCCAACCTTCTCTCCCGC<br>TTCACCCGGAACGAGTTCAACCTCGAGTCCAAGTCCACCATCGGCGT<br>CGAGTTCGCCACCAAGAGCTTGAGCATCGACGGCAAGGTCGTCAAGG<br>CCCAGATTTGGGACACCGCCGGCCAAGAAAGGTACCGTGCCATCACT<br>AGTGCTTACTATAGAGGAGCTGTTGGCGCTTTACTTGTGTATGACGT<br>CACCAGGCGTGCGACTTTTGAGAACGTTGCAAGGTGGCTGAGGGAGT<br>TGAGGGACCACACCGACCCCAACATCGTGGTCATGCTCATTGGCAAC<br>AAGTCTGATCTTCGCCACCTTGTGGCAGTCCCACTGGAGGATGGGAA<br>GTCATTTGCCGAGATGAGTCACTACTATTTCATGCAGACTTCTGCAT<br>TGGACGCGACCAATGTGGAAGCAGCTTTTGCTGAAGTCCTTAGTCAG<br>ATTTATCGGATTGTGAGCAAGAGAGCAGTCGAAGCGGGTGACAACCC<br>AAGTGTTTCTTCTGTTCCAGGTCAGGGACAAACGATCAATGTCAAAG<br>AAGAGGGGTCTGTTTTTAAGAGGATTGGATGCTGCTCTAGTTAAGGT<br>AGGTTTCTTCGGCTGCTTGTTGCTCCAAGGGTGGGTCTGCCAAGTGC<br>TACCTCTGTGTATATTTT |
| 22 | GGTCATTGAAGTCTAATCATCTTCAACCTCTCACCGAACAGACGCTG<br>CTGCTGCTCTCCTTCTTTCCCCTTCCCCATCAACACGCTCGTCTC<br>TGTCCCTGTCCCTGTCCCTGTTTCTCTCTACCCTCCGAGATCTCC<br>ACAGTAGAGAGAAAGACAGAGAGAGAGAGAGAGAGAAGTGACG<br>TGGTGACAGTAGAGAGAGAAAAGACCCGAGCTTGAGTCGTGGGTCGG<br>TCGTGGGCAATGGCGAGCGGAGGAGGCTACGGGACGGGAACCAGAA<br>GATCGACTACGTCTTCAAGGTGGTCCTGATCGGGGACTCCGCCGTCG<br>GGAAGTCCCAGATACTCTCCCGCTTCGCCCGCAACGAGTTCAGCCTC<br>GACTCCAAGGCCACCATCGGCGTCGAGTTCCAGACCCGGACCCTCGT |

TABLE 2-continued

Cell Signaling Gene Sequences

| SEQ ID NO | Sequence |
|---|---|
| | CATCCAGCACAAGAGCGTCAAGGCCCAGATCTGGGACACCGCCGGCC<br>AAGAACGATACAGAGCTGTTACGAGTGCATATTATAGGGGTGCGGTG<br>GGGGCAATGCTTGTTTATGACATTACCAGACGGCAGAGCTTCGATCA<br>CATACCTCGCTGGTTGGAAGAGCTGCGTAGCCATGCTGACAAGAACA<br>TTGTCATTATTCTGGTCGGTAACAAAACCGATCTCGAGAACCAGCGT<br>GCCGTGCCCACTGAGGACGCGAAAGAGTTTGCCCAGAAGGAAGGGCT<br>CTTCTTCTTGGAGACCTCTGCATTGGATTCTACCAATGTCGAGAGTG<br>CATTCTTGACTGTCTTGACCGAGATATTCAACATCGTCAACAAGAAG<br>AGCCTAGTTGCTGGAGAGAGCCAAACTAATGGCAATCCTGCATCTTT<br>GGCTGGCAAAAAGATCATCATCCCGGGTCCTGCCCAAGAAATCCCAG<br>CCAAGAACAAAATGTGTTGCGGAACATAATGCACTTCGACGTGATTT<br>TCCTCTTATGCTCTAGCAATTTTTCCTCAGATTTGTCATGTGTGCTG<br>CTTTATATTCTATGTATATCTACATATTAGAAGAGTGGTGGGGTTAT<br>ACTGCTGATTGTAATAGTGTGTTTCGTGAGGTCACAGACACAATAGA<br>CCTAACTGGGGTGCATATTCATTGAATGATTTTTGGCTTCGGAAGTT<br>ATATTTCATGCAATTTGCCAAAAAAAAAA |
| 23 | GTACGTTTCTAGAGAGAGAAAGTGAAGAGAGAGGATAGAAGAGAAGA<br>GAGAGAGAGAGAGAGAGAGAGCGCTGAGGAGGTTAGAGGTCATGGCT<br>GACGCCGCAGCTCAGAACGGCCAGTTCAGCGACTTCCCGGCGGTCCC<br>GACCCACGGCGGCCAGTTCATCCAGTACAACATCTTCGGCAACCACT<br>TCGAGATCACGGCCAAGTACCGGCCGCCGATCATGCCGATCGGCCGC<br>GGCGCGTACGGCATCGTCTGCTCTGTTCTGAACTCGGAGACGAACGA<br>GATGGTGGCGATCAAGAAGATAGCGAACGCGTTCGACAACCACATGG<br>ACGCCAAGCGGACGCTCCGCGAGATCAAGCTGCTCCGCCATCTGGAC<br>CACGAGAACGTTATTGGCATTAGAGATGTGATTCCTCCTCCCCTACG<br>GCGAGAATTTACTGATGTCTACATTGCTATGGAACTCATGGACACTG<br>ATCTTCACCAAATTATTCGTTCAAACCAAGGCTTGTCAGAAGAGCAC<br>TGTCAGTACTTCTTGTATCAGATTCTACGTGGACTGAAGTATATCCA<br>CTCTGCGAATGTTATTCATAGAGACTTGAAACCCAGCAATCTTTTGC<br>TGAATGCCAATTGTGACCTGAAGATCATTGACTTTGGCCTGGCACGG<br>CCAACTGCAGAAAATGAATTTATGACTGAATATGTGGTCACCAGATG<br>GTACAGGGCACCAGAATTGCTGTTGAACTCTTCAGATTATACTGCTG<br>CTATAGATGTGTGGTCTGTTGGTTGCATATTTATGGAGCTTATGAAC<br>AGAAAGCCTTTGTTCCCTGGGAGGGATCATGTGCATCAGATGCGTTT<br>GCTTGTAGAGCTTCTTGGTACACCAGCTGATGCCGATCTTGGGTTTG<br>TGCGAAATGAGGATGCACGCCGATACATAAGACAGCTTCCTCAGCAT<br>CCCCGTCAACCATTGGCTAGTGTTTTCCTCATGTTCACCCTTTGGC<br>CATCGATCTGGTTGAGAAGATGTTGACATTTGACCCAACAAAGAGAA<br>TCACAGTTGAAGAAGCACTCGCCCATCCTTATCTTACGAGATTACAC<br>GACATAGCTGATGAACCTGTGTGCCGACAACCATTTTCTTTTGAGTT<br>TGAGCAACAGCCCTTGGGAGAAGAGCAGATGAAGGACATGATATATC<br>AGGAGGCTATAGCGCTCAATCCAGAGTTTGCTTGATGCTGTTTAAAG<br>TTTCTATGGTGGATGAGGAACTGCGAACTAAAGTGGAAACAGTGCAG<br>CGCAACGAAATGAAGAGTTGCACATATTCAGAGGCAACCGATCTCGT<br>TGCTTTATTTTCCGTGGAGTAAGTATGCCGTACCACGAATACTGAT<br>TTGAGGGGAGCTTTGCTCCACCTGTCGAATAAACTTTCTTGATTCCT<br>TGAAACGCCTTTTGTTTTTGCAATCGGTGCTTCTTGGCATTCTTTTA<br>TTAGCTTGTATTTCACTCAACGTGCTTAATATCATTTTGTTGTAACA<br>TTTCACAGTTTGTAAATTTGTACTGCAAGATGTATTAGTAAGAAGAA<br>CTGTATTTTTTTATTTTTTGGTTCATTGAACCGTGCTTCAGTTT<br>ATGAATGCTAATCTGTATGTAACGCGCAGAGCAGGGCGCTAGAGCTT<br>TTATCTGTGCCTTCACAACTTCTGTTTTATTATAAATCCCTTCGTTC<br>CCAAAAAAAAAA |
| 24 | TTCTCGATAAGCAATAATTGCTGCCCTTCTCTTTTCCTCGTCACTGC<br>TACAGAGGCCGGGTCTAATCGCGACGAGGTGACGAATCTGAGATCGA<br>AAGTCGTCTCCTCTTGTTGCGGGGTCAGATCCGTAGGGCTCGTGGCT<br>TGACAAGAACAGTGCTTTCCGAGGGAATAAGCAGATCCCAATGCGTT<br>AGGGGAATGATTGCGTAGGGCTGCGATCTTGGGCATCTGTTGCTGTC<br>GGGAATTCTTGCGAGGAGAAGGGCCTCTGAGGCTGCGTCGTGCTGGG<br>GAGTTGATGAATTGCGCCTGCTCGGGGAAGAGTGAGTGGGATCCGA<br>CGATGGGTCTGAGCAAGAATGGCTTCTTTCTTTGAATTCGCTTCGAA<br>GATCACATAAAAAGCAAATGGCAACACTAGTTGAGCCGCCAAATGGG<br>GTTCATTCCGAGGGAAAGCACTATTACTCGATGTGGCAGACCTTGTT<br>TGAGATTGACACAAAGTATGTGCCCATCAAGCCCATTGGCCGGGGAG<br>CCTATGGCATTGTTTGCTCTTCTGTGAACAGAGAAACCAATGAGAAG<br>GTGGCTATAAAGAAAATTCACAATGCCTTCGAGAATCGGGTTGATGC<br>GCTGAGAACTTTGCGCGAGATAAAGCTTCTCAGGCATCTTCGGCATG<br>AGAACGTCATTGGTCTGAAAGACGTCATGATGCCTATCCAGAGGAAA<br>AGTTTCAAAGATGTCTATCTGGTGTATGAGCTTATGGACACAGATCT<br>GCACCAGATAATCAAATCCTCTCAGACACTTACGAATGACCACTGCC<br>AATATTTCCTCTTCCAGTTGCTACGAGGCTTGAAGTATCTACATTCA |

TABLE 2-continued

Cell Signaling Gene Sequences

| SEQ ID NO | Sequence |
|---|---|
| | GCAAACATTCTCCACCGAGACTTGAAGCCAGGGAACCTTCTCATCAA<br>TGCAAACTGTGACCTCAAGATCTGCGATTTTGGGTTGGCACGAGCTA<br>GCAATGGAAAGGGACAGTTCATGACTGAGTATGTGGTCACTCGCTGG<br>TACCGGGCCCCAGAACTCCTTCTGTGCTGTGACAACTACGGCACATC<br>CATCGATGTGTGGTCTGTTGGATGCATCTTCGCTGAGCTTCTCGGAC<br>GTAAGCCATTATTCCCTGGTACTGAGTGCCTCAACCAACTCAAACTG<br>ATCATCAATGTCCTCGGCAGCCAAAGAGAGGAGGATATCGAATTTAT<br>CGACAACCCAAAGGCGAAAAAGTTCATAAAGTCTGTCCCATATTCCC<br>CAGGGACTCCATTATCCCGTCTTTACCCTAATGCACATCCTCTGGCT<br>ATTGATCTCCTGCAAAAGATGCTCATTTTCGACCCATCAAAGCGCAT<br>TGGCGTCACTGAGGCTCTCCAACACCCATACATGTCACCGCTGTATG<br>ATCCGAATACCAATCCTCCTGCGCAGGTTCCCATCGACTTAGATGTC<br>AATGAAGATCTGGAGGAAGAGATGATAAGGGAGATGATGTGGAAGGA<br>AATGCTCCATTACCATCCCGAAGTCGCTGTGGGCAATTTAGAGGTGT<br>ACTCTTAAGCATTCTTCAGTTGTTTTGTCTCGCCTCTCTGTGATAAG<br>GTACTCCATCAATATGCTGCTGCACTTCATTATGATGGTTCTGTAGT<br>TTCTCTTAACATATAGGCTAGCTTTTCCTCTTTTTCTCAGAGAGGGG<br>ATAAAATAATTTGCTGGAATCATGCCCAGGAAGTTCTTGTCCTCAAA<br>ATGCATGATTGAGCAACCGTTATCTTTCTTCTTCACTATGTCTGTTT<br>GAGATCCATGTACTAGGTTTCCTATCTAACCTGTAAATAGCCTTATT<br>GCTATGAGACTTCAGGCTTGTTGTACAATTATATGATATGCTTGAGG<br>ATGCTTTTATAACATCTGGTTTGGACGTAATAAGAGTACTTCTAAAG<br>CTGTAAAAAAAAA |
| 25 | GCTCTCTCTTCGTTCGCTTCACTGCCCCCTCTCTCTCTCTTTCTCT<br>CTCTCTCCTCGAGCTGAGCTCAACTCGAACAAGAGCATTGCGGTTCA<br>CACAGAGGAGGGCAGAGGAGAGAGAAAGATAGAGAGAGAGAGAGA<br>GAGGAGGAGGAGGAGAGAGAGAGCTCTGCATATTCAGGGTCATTGAG<br>GAGATTTGTATCTACTTATGGAGATTGTAGATTCTGCGATCTGAGAA<br>ATTCGGGAGCTCTGCTTATCTTTTTCTCTTCCTGTCTTGTCTTTTTT<br>GTTTGTTTTTCGTTTTTTTGGGTCTCCCTCTTCTCAGCTGCTGCTG<br>CTTGCTGCAGCTGCTGCAGCAATCATCATCATGACTTCTTGATTCGT<br>AGATGATAGGTGAAGAAGAAGAAGAAGAAAGGGGGGGTTTTTCTCTT<br>TCTCTGCTCTCTTTCCTAGCTCTCTGCTCCTTACCCAGAAAGCCGTT<br>CGTTCTCTCTCGGGCCGGAATTTGCTCAGCGTCTGTCTTTTCCTC<br>TCTCCGTTCAGATCTAATCGGAATCGGGAAGATATGTAAGGGGGGGT<br>CTTCTGGGTTTTGTCCGTCGCCATTTCCTCTCGAGCCTCGCGCGGTT<br>TTAAGCGTTTAGATCTGGGTTTTTCTTAGCTGGGTAGGTTTGGATTC<br>AGTTCGCAGGTTGTAGTAGCTTAATCTCTGTACATTTGTTTTTTTTT<br>TTTTTTTTTTTTGTCTCCGAGCTATTTGGTTCTTTTGGGGCGAAGG<br>GTTGTGTTGGGATTAGGTTGTTTTGCCGCCCCCGGCTGTTTTTTT<br>CGTTAGGGTTTCTGTTCTTTTTCTTCTTTCTTCCTGCGGGAGGGAT<br>GGATTGAGGGCTCATTTCGTTTGAAAGTTGGGATTTTTTTTTTCCTG<br>GGCAGTCGTGGGAATTGGATTTGTCACTTGGGTAAGGGAAGATGAAT<br>TATTTTCCCGATGAAGTTATCGATCACGTGTTCGACTTTGTGACGTC<br>GAACAGGGACCGCAACGTGATCTCTTTAGTGTGTAAATCTTGGTATA<br>GGATCGAGAGGCTTAGCAGGCAGAGAGTGTTTATCGGGAACTGCTAC<br>GCGATAAGTCCTGAGAGATTGATCGCGAGATTCCCGGGGGTAAGGTC<br>GCTCACTTTGAAGGGGAAGCCCCATTTCGCTGACTTCAATCTAGTGC<br>CACCTGACTGGGGAGGGTTCGTGTACCCTTGGATCGATGCATTGGCT<br>AGGAGTAAGGTTAATTTGGAGGAGCTCAGGTTGAAGAGGATGGTGGT<br>TACAGATGATGGTCTTGAGCTGATTTCGAGATCGTTTGTAAATTTCA<br>AGTCCTTGGTTCTTGTTAGCTGCGAAGGGTTCACTACTGATGGCCTT<br>GCGGCTATAGCAGCCAACTGTAGGTTTCTTAGGGAGCTGGACTTGCA<br>AGAAAATGAAGTTGAGGATCATAGAGGCCAGTGGCTAAACTGCTTTC<br>CCGATAGCTGCACCTCTCTTGTCTCCCTAAATTTTGCATGCTTAAAA<br>GGAGATATAAATTTAGCAGCACTTGAGAGGCTTGTGGCAAGATCTCC<br>ATATCTCAAGAGCTTGAGGCTAAGCCGTGCTGTCCCTCTTGACACGC<br>TGCAGAAGATCCTGGTCCGAGCACCTCAGTTGGTGGACTTAGGCGTG<br>GGCTCTTTTGTCCATGACCCAGATTCTGAAACCTACAACAAGTTGGT<br>GACAGCAATTGAAAAATGCAAATCTATGAGGAGCTTATCCGGATTCT<br>TGGAGGTTTCTGCGTACTGCCTACCAGCTATTTATCCAATATGTTCA<br>GGCCTGACCTCCTTGAATCTTAGTTATGCTCCTGGGATCCCTGGAAG<br>TGAGCTAACTAAGTTAATCCGTCATTGCAGAAAGCTGCAGCGCTTAT<br>GGATACTTGACTGCATAGGAGATAAAGGGCTGGGAGTCGTGGCTTCA<br>AGCTGCAAAGAACTACAGGAATTGAGGGTTTTTCCGTCTGATCCTTA<br>CGGAGTTGGAAATGCTGCAGTGACCGAAGAAGGGTTGGTTGCTATTT<br>CCAGAGGTTGTCCAAAGCTTAACTCACTGCTGTACTTCTGCCAGCAG<br>ATGACAAATGCTGCCCTGAAAATTGTAGCCCAGAACTGCCCTAATTT<br>CATACGGTTCAGGTTGTGCATCCTCGAGCCCACAAAACCGGATTCTT<br>CAACCAATCAGCCTCTTGACGAAGGATTCGGAGCTATTGTTCAGTCA<br>TGCAAGGGTGTCAGGCGCTTGTCACTTTCTGGCCTTCTTACTGACCA<br>GGTCTTCAATTATATTGGCACATTCGCTGAACAGCTTGAGATGCTTT |

TABLE 2-continued

Cell Signaling Gene Sequences

| SEQ ID NO | Sequence |
|---|---|
|  | CTATTGCATTTGCTGGGGACAACGACAAGGGAATGCTTTATGTGTTA<br>AATGGGTGCAAGAAGATTCGGAAATTGGAAATCAGGGATTGCCCCTT<br>TGGTAACATCGCACTTCTGACGGACGTGGGAAAGTATGAAACAATGC<br>GATCCCTTTGGATGTCGTCGTGCGATATTACCCTTGGAGGCTGCAAA<br>CCCTGGCAAAGAAGATGCCGAGGCTGAACGTGGAGATTATCAATGAA<br>AACAATGAGATGGAGGATTGCATTGATGATGAGCAGAAAGTAGAAAG<br>GATGTACCTCTACAGAACCTTGGTGGGGCCGAGGAAGGATGCACCAG<br>AGCATGTTTGGACATTGTAGGGTTCCCCTGAGGTTCATTGCCATGGC<br>TTTGCCTCAAAATCTCCTGTTGTACCATCATTGTACCTCGTTTAGGC<br>TCGTAATTTGTGGATTTTTAGTTGTATGGTGATTTTTTATTTTATTC<br>AGAAGAGATTCTAATGTGCTTCTAGTTATAAATAGATTTTTCTTTAG<br>CAAAAAAAAA |
| 26 | GCTCCCTTGTTCCTTATCTCTTCCATTTCCTCAGCCTCTGCTGTTCC<br>TCCACTGGACCTCCCACCACCCCCTCCCTCCTCCCTCCTCCCCCCT<br>AACCCCCCAAGAAAATCAAGAAAATCAAGAAAAGAGACGCTGCCAGC<br>AAAAGCAGCAGCATGCTAGTCATAAAACCTCCTCCACTCCCTGCTGC<br>CATGAACGAAATTTGATCCTCAGCTCCCCACTCACAGCCCTCCGAAA<br>TCTCTGAAATCAAAGCAAGGAAAGAGAGAGAGAAGAGAGAGAAGAGA<br>GAGGGGAAAGAGAGATGAAGAGGGATCATCGAGACGCTTGCAGTGGC<br>GGCTATGGCGGCGGCGGTGGCGGGGAGGCGAGCGGCGCCTCGAAGGG<br>CGAGCCCCCGTCGTCCTCCTCCACCCACTCATTGCCCGGCTCTGGCA<br>AGGCCAAGATGGTGATGTGGGGCGAGGACGACCAAGATCCGAGCGGC<br>GGTGGCGGGGGCGGCATGGACGAGCTCCTCGCGGTGCTCGGGTACAA<br>GGTGAGGTCGTCGGACATGGCCGAGGTGGCGCAGAAGCTGGAGCAGC<br>TCGAGATGGTGATGGGCTCTGCTCAGGAGGACGGCATCTCGCACCTG<br>TCCTACGACGCCGTCCACTACAACCCTTCCGATCTCTCCTCGTGGGT<br>CCAGAGCATGCTCTTCGAGCTCAACCCCCCTCCGCCGCCGCAGCAGG<br>TGGCCGACGCGGTCCTCGCTGCGGCCGAGTCGTCTTCCACCATCGCG<br>CAGCACCACCGTTCGCATCTCGGGTCTCGGTCTCAGACGCAGACTCG<br>GACTCTGAGTCAGACTTCGGCTCCCACTCAGACGCAGTCCCAGGTAA<br>TCTTCAACGACGACTCCGAGTACGACTTGAGGGCGATTCCCGGCGTC<br>GCCGCTTTCCCACAGGGCGACTCGGACTTCGAGAGCGCCGCCCGGAA<br>GAAGATGAAGACCCTGAACGGCGGGTCGAATTCGTTGTCGTCCTCGT<br>CCTCTTCGTCGGCCGCCGGAGCGGCGCCCTCCGAGTCGACCCGGCCG<br>GTCGTCCTGGTGGACACGCAGGAGACTGGGGTGCGGCTCGTCCACAC<br>GCTCATGGCCTGCGCCGAGGCGGTCCAGCAGGAGAACCTGAAGCTGG<br>CCGATGCGCTCGTCAAGCACATTGGCCTGCTCGCCGCTTCGCAGAAC<br>GGCGCGATGCGCAAGGTAGCGACCTACTTCGCCGAGGCGCTCGCCCG<br>CCGGATTTACCGAATCTACCCCAACGACGGCAGCCTCGACTCCTCGT<br>GCAACGACATCCTCCAGATGCACTTCTACGAGACCTGCCCGTACCTC<br>AAATTCGCCCACTTCACTGCCAATCAGGCGATTCTTGAAGCCTTCGC<br>CACCGCCAGCCGCGTCCACGTCATCGATTTCGGCCTCAAGCAGGGTA<br>TGCAGTGGCCGGCCCTCATGCAGGCTCTGGCCCTGAGGCCCGGCGGT<br>CCGCCCGCCTTCCGGCTCACCGGGATTGGCCGCCGCAGCCGAACAA<br>CACCGACGCCTTGCAGCAGGTCGGCTGGAAGCTGGCTCAATTGGCCG<br>ACACTATCGGGGTCGAGTTCGAATTCCGGGGTTTCGTGGCGAATTCG<br>CTGGCTGATCTCGAGCCCGCCATGCTGGACATCCGCCCTCCCGAGGT<br>CGAGACGGTGGCCGTCAACTCGGTGTTTGAGCTCCACCCCCTGCTCG<br>CCCGACCGGGGGCGATTGACAAGGTTCTCTCATCGATCAAGGCCATG<br>AGACCTAAGATAGTGACGATGGTGGAACAGGAGGCGAATCACAATGG<br>CCCGGGGTTCGTGGACCGGTTCACGGAAGCTTTGCATTACTACTCCA<br>GCCTGTTCGATTCGCTGGAAGGGTCTGGGGTGGCTCCCCCGAACCAG<br>GATCTGGTCATGTCCGAGGTCTACTTGGGTCGGCAGATTTGCAATGT<br>TGTGGCCTGCGAGGGGCCGGATCGAGTGGAGCGGCACGAGACGTTGG<br>TGCAGTGGCAGGCGCGGATGGGATCGGCTGGGTTCGACCCGGTCCAT<br>CTCGGGTCCAACGCGTTCAAGCAGGCGAGCATGCTGCTGGCCCTGTT<br>CGCAGGTGGAGAAGGTTACCGGGTCGAGGAAAACGATGGTTGTCTCA<br>TGCTCGGTTGGCACACGAGGCCTCTGATCGCCACTTCGGCGTGGCAA<br>CTCGCTGCTGCAACTCAGTGAATCAACTGTCGTTCGGTTGAGTTTGG<br>TCGAAATCGAGATAGACCCTGTTGTCGGTTGGACCCCTTAGATGATC<br>AGTGAATGGAAGTGCTTTGCCTGAGTTGGGAAGGTACTAAGAGAAGA<br>GAGGCTACGAAACAACCTCAGAGCGTGTAGTTCCACTTCTTGTTTTT<br>TGCCTCTGTGTAGTCTTCTGCAAGATCTTCCAAATCTTCCTTATTGA<br>TTTATTTCATGAATTTTGATTTTGGTTAGACCTTTGGGCTCTACTCA<br>AGGTTGGATGAATGCGAATGTGTATCCTCTGCATTTAGCTTCTGGAA<br>TAAAATGATGACGACGACGATTCTCGCTGCCAAAAAAAAACGGATGC<br>AATCGTTTACGATTCATCACATCTCTATGGAACTCCAAGTTACTGGG<br>TGCAACAGTTTTTCGCCGAGTCAAGTGGAGCAACTCTTCTTGATACA<br>ACAATTCCAGCGAATTACTCCAGCTCACTTCTCGCCTCAGCAATCAC<br>GTGGACAAATTCAGATGATGATAAAAGTTATATAAAGATTAAGATCG<br>TGAACTTCGGTAGCAGTCCAGTTAATCTAACAATTTCCATTAGCGGA<br>CTGGATCAAAATTCGATACAAAAGTCTGGATCCTCAAAGACGGTATT |

TABLE 2-continued

Cell Signaling Gene Sequences

| SEQ ID NO | Sequence |
|---|---|
| | GACATCTGCTAACTTGAAGGATGAGAACTCCTTTTCTGAGCCGAACA<br>AGGTGGTGCCAACCCAAAGTCTACTCGAAAATGCAGGCAAAGAGATG<br>GATGTTGTTATCTTGCCCTATTCCTTCACTTCCTTTGATCTGTTAAA<br>AGAATCGACTAGCATCCGGATGAAGGGAGATGATTATTCGTCTAAAT<br>CTTCTATCTAATTTATATATCTGATTGAGTGTAATTATATGGAATAA<br>TCTCATGACTCAGATGTTATGATACTCAAAAGTTATGTAGATCTTTG<br>TGGCTGTAACATGTACTTCTTGCTTACCTGTTCGATGCTATATAATA<br>TAAATTATATTACATAAAAAAAAAA |
| 27 | TTCCTCTCCCCCCACTTCCTTTTTGCCCTATCTGATAGGGTTTCTCA<br>CCTTCTTCCCCCCTCCCTCTCATGCATTCTTGCCCGCTAGCAGCCCT<br>GCAAATCGCCCTGACCTTCTTGATCGTCGTCTCGGGATCCGCCTTTT<br>TTGCTCTCTCTCGAGGGTTTTCGGTCGCGACCGTTTCGGAGCCCGC<br>CTCCCGGAGTCACCGGAGCCGTTCCCATGTCGAAGGTCCTCAGATTC<br>ACTGGAGGCGAGGATTTTTACTCTGGGAGGTCAATATACCAAAGCCC<br>AAAGGAGGTCAACCTCTTTTTGTCCCTTGGTAACCATGTGGACGTGT<br>ATTTTCCTCCTAGCAAGAGGTCCCGCATCAGCGCTCCGTTTGTTTTC<br>AGTGAGGACCTATTCGAGCAGAAAAGGCAGGACACAATCGAAGTTCT<br>TCCAGATGAGTGCCTCTTTGAGATATTCAGAAGGTTGCCTGGAGGCC<br>AGGAGAGGAGTGCCTGCGCTTGTGTCTCCAAACGCTGGCTCAATCTT<br>TTAAGCAATATATGCCCCAATGAACGCAGCTCTGGTAAATCTCAGAA<br>CAATTTGGATCCTACCTGTGGGGGAGAGGAAGTGAGTTCAGAGGACG<br>ATGGATTTCTCTAGGAGCTTGGAAGGGAAAAAGGCCACTGATATC<br>CGTCTTGCTGCCATAGCTGTGGGAACTGCTGATCGTGGGGGATTGGG<br>CAAACTTTCAATCAGGGGTAGCAAGTTGTCCCATGTGACAAGCCTTG<br>GTCTTGGGGCAATAGCACGCAGTTGCCCCTCTCTTAAGGCCCTGTCC<br>CTTTGGCACCTACCTTCTGTCGGAGACGAAGGTTTACTCGAGGTTGC<br>AAATGGTTGTCACCAGCTTGAGAAGCTAGATCTTTGCCAGTGTCCCA<br>ACATTACCAACAAGTTTTTGGTTGCAGTTGCAAGGAACTGCCCTAAT<br>TTGACCGACATATCAATAGAGTCTTGTTCTAGCATTGGAAATGAAGG<br>TTTGGCTGCTGTTGGACAGTTCTGCCAGAATCTGAAGTCCATTTCAA<br>TCAAAAATTGCCCCAGTGTTGGAGATCAGGGCATTGTTGGTCTGATT<br>TCGAGGGCTGGTAGTGCCTTAACAAAGTTCAATTGCAGGCATTAAA<br>CATAACTGATGTATCTCTTGCGGTCATTGGGCACTATGCCACGGCTG<br>TTACCGATTTAACCCTTGCGAGCCTCCACAATGTCACAGAGAGAGGG<br>TTTTGGGTCATGGGCAATGGTCATGGCTTGCAAAGGCTGAGGTCTTT<br>GATAGTCACCGCTTGTCGGGGTGCTACTGATCTGGGACTTGAATCTC<br>TGGGGAAAGGTTGCCCTAATCTTAAGCAGTTATGCATCCGTTCATCT<br>GCATTCCTGTCAGATGGTGGCCTTGTTTCTTTCATGAAGTCAGCAAG<br>GTCACTTGAGAGCCTGCAATTGGAGGAGTGCCACAGGATTACCCTGT<br>CAGGACTATATGGTCTTGTCGTTGGTTGTGGGGATAAACTGAAATCT<br>CTTGCTCTGACAAATTGCTGGGGATTTAAGGACTTTGATTTTGGATC<br>ACCTCAAGTGTCTCCTTGCAAGTCCCTGCGCTCTTTCTCTGTTCGCA<br>ACTGCCCAGGCTTTGGTGATGCGTGCTTGGTGGCACTTGGGAAGATT<br>TGCCCACATCTGCAGCAAGTAGAATTGAGTGGGCTTACAGGAATAAC<br>GGATGAAGGCTTTTACGACTGCTTGAATGCTGTGAAGCTGGTCTTG<br>TGAAGGTTAACCTCAGTGGATGCATCAACCTGACAGATCAAGTGGTT<br>TCAGCAATGGCTAAGTTGCATGGTAGGACCCTTGAGGTGCTAATTCT<br>GGATGGTTGTACAAAAGTTAGTGATCTGGGCTTGCTGGCTATTGCAG<br>AAAATTGCCAACTGCTATCTGATCTCGATGTCTCGAAAATGTGCAAT<br>TCGGATTTTGGATTGATGGCATTGGCTCGTTCTAGTCAACTGAGTT<br>TGCAAGTCCTTTCCGTGTCTGGTTGCTCTTTGGTGTCAGACAAGTGC<br>TTGCCTGCTCTTAAGAAAGTGGGCCGCACCCTTTTAGGTTTAAATCT<br>CCAACATTGCACTGCAATCAGCACTCGTTCGGTGGACCTGCTTTTGG<br>AAGAGCTTTGGAGGTGTGACATTCTCGCTTGATTGAGAGTGGATGGA<br>AATTGCAGTTTCGTCTGAAGATTGATTTATTTGTTATGAAGACTAG<br>AGTTCAACTCGGCCTATGTGGACAGCTACAGTTTGTGTTAGTTTTTG<br>GATCCAGAATCCAGCGGATATGGGTGTTGAAGCAAAATCCGGTGCTT<br>GGTCCTTTTTTCAGGGAATATGGCCTTTCTTTTTTGGCAGGCTTCCG<br>AATTGGGAATCTGTTCTTAGTAGTTTTGCCTCTCCAAGACGAGAGGA<br>GTCATTTATGGCCAGATTTTCCTGAGAATGTCCTGACCAAGTTCCGG<br>TTCAGTTCATCATCAATTTCGACAGAGTTTTTATGATGCCTGGGTTG<br>GTATCTGCTGTTTTAGCTCGGCATCATGCTGGTCAACTATGCTGGCT<br>TGTGATCAACTTTTCTCCGCGTCTGGATCCTTGCACTTGCAGGAATA<br>TTTCGGTTCTGACAGGTCTTTCTTGTTCCAGATCCTTGTATGTCATG<br>GGCGGGTCATTCTCCAGAGTTTTGGTGACGGTCGCGGTTGCTTTTCA<br>TGCTTACAATGCCTTGGATTCTTGGGCTTAGGCCATGGCAGCTGCTC<br>AAGCAGTTCTTGCCATCACAACCCATGAGGTTGTTTTTTTCTAGCCAA<br>GCCTTGTTTTTCCCGGCATTGCGGTGTGGAAAGTTTCTTCGACCGTT<br>TCGCCACACGTTGTTAGAATCTCCCTCCCCCCTGACTATATGTTGGT<br>TTTACAGTTTGTCAAGTGAAATAAAAGCAGTGTACTTGTTCATGTTC<br>TAAAAAAAAAA |

TABLE 2-continued

Cell Signaling Gene Sequences

| SEQ ID NO | Sequence |
|---|---|
| 28 | GGTAACATTGAGGTCCTCCTCTGCACGTTTCTCCTTCGTCATCGGGG<br>TTCTCTTACCTAGGGTTTGCAGGCGGGCGCCACTCTTCTCCGCTGTT<br>TCTACCTCTCTCGTTTGGCAGCCATGGGAGAATCCAGGAGAGGAGAG<br>ATGGATGGAACGACTCGAGGGGGCAGCAATGCGGACATGTATCTGCC<br>GAATTATAAGCTCGGGAAGACTCTGGGCATCGGTTCGTTTGGTAAGG<br>TGAAAATAGCGGAACACGTGTTGACTGGGCACAAGGTCGCCATAAAG<br>ATCCTCAACCGGCGCAAGATAAAGAACATGGAGATGAAGAGAAAGT<br>GAGGAGAGAAATAAAAATCCTCAGACTCTTTATGCATCCGCACATCA<br>TCCGACTTTATGAAGTCATTGAGACGCCTACGGACATTTATGTTGTG<br>ATGGAGTATGTGAAGTCTGGGGAGCTGTTTGATTACATTGTCGAGAA<br>GGGCAGGTTGCAGGAGAATGAAGCTCGCAACTTTTTTCAGCAGATTA<br>TTTCCGGTGTGGAATACTGCCATAGGAATATGGTCGTTCATAGAGAT<br>CTAAAGCCTGAAAACTTGCTGTTGGATTCTAAATGGAATGTGAAGAT<br>CGCAGATTTCGGTCTGAGCAATATAATGCGTGACGGTCATTTCTTAA<br>AGACAAGTTGTGGGAGCCCCAACTATGCCGCTCCGGAGGTTATCTCT<br>GGTAAACTTTATGCGGGGCCTGAAGTAGATGTATGGAGCTGTGGAGT<br>TATATTATACGCTCTTCTTTGTGGCACACTCCCTTTCGATGATGAAA<br>ACATACCTAACCTTTTCAAGAAAATCAAGGGTGGGATGTACACTCTT<br>CCAAGTCACTTATCGGCAGGTTCAAAGGACTTGATCCCAAGGATGCT<br>TATAGTTAATCCAATGAAACGAATCACCATTCCAGAGATCCGTCAGC<br>ATCCTTGGTTTCAAGCTCATCTTCCACGTTATTTGGCCGTGCCTCCA<br>CCTGATACGATGCAGCAAGCGAAAAAGATTGACGAGGAAATACTCCA<br>GGAAGTGGTCAACATGGGTTTTGAGCGCAATCAACTTGTCGAATCAC<br>TTCGCAACCGGATTCAAAATGAGGCTACTGTTGCATACTACTTGTTA<br>TTGGATAACCGTTTCCGACCTTCCAATGGCTACCTCGGAGACGAGTT<br>TCAAGAAACGATGGAGTGCACCTTCAATCGTGGAAATCCAGGGGAGC<br>TTACCATTCCAACTGTTGGGCCTCGCTACCCACTACCTGGATATATG<br>GATTACCAGGGAGTGAATTCAAAACCAGGTTATTATGGTGCTGAGAA<br>GAAATGGGCTCTTGGTCTCCAGTCTCGAGCCCATCCACGGGAAATAA<br>TGACTGAAGTTCTTAAGGCGCTGCGAGAACTAAATGTGTGCTGGAAG<br>AAGATTGGGCACTATAACATGAAGTGCATGTGGAATCCTTGTGTTCC<br>CAGTCATGAGAGCATGGTTAGCAATCCTGTCCAGAGTAATTATTTTG<br>GTGATGAATCTACAATAATCGAGAATGATGGCGCAACCAAGTCCAGA<br>AATGTGGTCAAGTTTGAGGTGCAGCTTTACAAAACGACGGAGGAGAA<br>ATATTTACTCGATTTGCAGAGGGTGCAGGGACCCCAGTTTCTGTTTT<br>TGGACCTCTGTGCTGCTTTTCTTGCCCAACTCCGGGTCCTTTAGGAA<br>GAGAAGGGTGAAGATATCCACGAAAAGTCCTGCCAATAAAACTTGTG<br>AATAACCATTGGAGGATTTTAGGCGTTCAACATTCATCAGGAAATTG<br>ATATCAAGCTTTTTGTTCTATATCAAAAATAAAACGTTAAAGAAAAA<br>CTCGTGGAAAATACAGTTTTGTACCAACTGACGAGGTCGTTTCAGAT<br>GTTGTGTACTTAATCGAAAGTGATCTTTATTTACACTTAAAAAAAAA<br>A |
| 29 | GAAGGGGGGCTCTCTGTTTTTTTTAACGAGGAAGGAAACAAGCACGT<br>CGTGCAACTTGCCGTGTAGCTCTCGAAAACGCCCCTCCTTCTCTCTT<br>TCTCTCTCTTCTCTCTTCTCTCTTTCTCCTGGGTCTGAGCAAGAA<br>ATGGCAGGGTACAGAGCAGAGGATGACTACGACTACCTCTTCAAAAT<br>TGTCTCTCCAGATTCACCAGGAACGAGTTCAGCCTCGAGTCGAAGTCCACCATTGGG<br>GATTCACCAGGAACGAGTTCAGCCTCGAGTCGAAGTCCACCATTGGG<br>GTCGAGTTCGCCACTCGGAGCTTAACGTCGATGGCAAGGTCATCAA<br>GGCCCAGATTTGGGACACCGCTGGTCAAGAAAGGTACCGTGCCATCA<br>CTAGTGCTTATTACCGGGGAGCTGTGGGCGCATTACTTGTGTACGAC<br>GTTACTCGTCACTCCACATTCGAAAACGTGGAGAGATGGTTGAGGGA<br>ATTGAGGGATCACACGGACCCCAACATCGTGGTCATGCTCGTCGGCA<br>ACAAGTCCGATCTCCGGCACCTCCTGGCAGTCTCAACAGAGGATGGG<br>AAATCATTTGCGGAGAGAGAGGCCCTCGTCTTCATGGAAACTTCTGC<br>ACTCGAGGCGACCAACGTGGAGAATGCTTTCGCCGAAGTCTTGACTC<br>AGATTTACAACATCGTGAGCAAGAAGGCCCTGGAAACAAGTGAGCAA<br>GCAAATGGCTCGGCTGTGCCGTCTCAGGGAGAAGATTGATGTTGG<br>TAAGGATGTGTCAGCTGTCAAGAGAGGTGGATGCTGCTCAAGCTAGT<br>CAGATTCTTGGAACATTCGAGAGTTTTGGATTACTGGGTAGTTGCCG<br>TTTTTCCTGTCATCATATTTTGCGATATATAGCGTGAGATATTTTTT<br>CTGCACGACACTGGCCGATCCGGTCTAGATTGCAGGTACACGAATTT<br>GTATCATTTATGTCAGCGATTTCTTGTGATGGGTACAGAGCTTAATT<br>TAGGAAACTGCTTGTTAATTTTACATCTATTGGTTCATTACCATGTT<br>GGTCTTCTTTTGTTTTTAGGACACAATGTATTAGGTGCTTGATGCTA<br>GCGCGGACACATTGTATTATTTTCCGAGGGAATCATGACGTTGAATT<br>GGAAAAAAAAA |
| 30 | CCAAGCTGTCTTCATCATTTCTCGCTGGGAATCAATTTGAATTCGAT<br>TTCGATTTCGCCGTGTCGATCGAGGATCGCTCGATCGATCGATCGAT<br>CAGAATCCCCAGTTCGTCTGAATCCTTCTCTCCCTCCCTCCCTCTCT<br>CTCTCTCTGTGTCTCTCTCTCGCCATTTCCGTGAGATCCAGCTATGG |

TABLE 2-continued

Cell Signaling Gene Sequences

| SEQ ID NO | Sequence |
|---|---|
|  | ACTCCTCTCGCGAGAGCCTGGTCTACGTCGCGAAGCTCGCGGAGCAA
GCCGAGCGCTACGAGGAGATGGTGGATGAAATGAAGAGGTTGCGAAG
CTCAATGTTGCATTAACCGTTGAAGAGAGAAACCTGCTATCTGTTGG
GTACAAAAATGTTATTGGGGCTCGGAGAGCATCCTGGAGGATTCTGA
CATCCATAGAGCAAAAGGAAGATGCAAGGGGGAACGAGATCAGTGTG
AAGCGAATCAAAGAGTACAGGAAGAAGGTTGAATCAGAGCTCTCTAG
CATCTGCAGCGATATCATGGTCATACTTGATGAGCATGTCATTCCTT
CAGCATCAGACGGTGAATCCAAAGTATTTTACTATAAGATGAAGGGA
GACTACTACCGTTATCTTGCGGAATTCAAGAGTGATGACGAGAAGAA
AGAGGTTGCTGAACAGTCAATGAAAGCTTATGAGATGGCTACAAGTA
TTGCAGAGTCCGATTTGCCTTATACACATCCCATCCGCCTTGGTTTG
GCTTTGAATTTTTCGGTGTTTTACTATGAGATCCTCAACTCAGCTGA
AAGGGCATGCCACATCGCAAAGCAGGCATTTGATGATGCAATTGCAG
AACTTGACAACCTCAATGAGGAGTCTTACAAAGATAGCACTTTAATC
ATGCAACTTCTCAGGGACAATCTCACATTGTGGACATCTGACATCAC
AGAGGAAGGAGAAGATGCACAAAGGATAAATGGCTCAGCTAAAGTTG
GCATGGAAGAAGGAGAGTAAAACAGGTGTAACCCTGAATCATATGCC
TTGCAGTGGGTCGACGCGGCCGCG |
| 31 | CGTTTCCGCGCTTCTGCTCGCGCGTCCTCTCGCTCGAGGCTTTCCGC
TTCCTTCTTCCGAACCCCTTAAAGGTCGGTCTTTCCCTCCCCCCTC
TCGATGGATCCGGCCGCCGGCTCCGGCTCCGGCTCCGGGCTGATCCG
ATTAGGGTTCTTGGCCGGCTCCGACGAGTGAGCTGTCGCCCGCCTCC
TCGCGGGCGGTTTTCCGGCGGCGGGTTTAGGGTTTTGCCCTTTTTCC
GTTCTTGAGAGAGAGAGAGATAGATAGAGAGAGAGAGGGGGGGGA
GGTGATGGAGGATCGGAACGTGAAGAGGCCGGACAGCCCGGGGCTTT
CCGACATCGTGTTGACCTGCGTCATGCCGTACATCGACGACCCCAAG
GATCGGGACGCGATTTCCCTGGTCTGCCGCCGCTGGTACGAGATTGA
CGCCCTCACGAGGAAGCACGTCACCATCGCCCTCTGCTACACCACCA
GCCCCGAACGGCTGCGCAGGAGGTTCAGGCACCTCGAGTCGCTCAAG
CTCAAGGGGAAGCCGAGGGCCGCCATGTTCAATCTGATACCCGAGAA
TTGGGGCGGGTACGTGACTCCCTGGGTGACCGAGATCGCGCAGTCTT
TCGATTGCTTGAAGTCGCTTCACTTTCGGCGCATGATCGTGGAAGAT
TCGAACTTGGAGGTGCTCGCCACGTCGCGGGGACGCGTTCTGCAAGT
GCTCAAACTCGACAAGTGCTCTGGTTTCTCGACCGACGGGCTTTTAC
ACGTGGGGCGTTTATGCAAGACTTTAAGAACCTTCTTTTTGGAAGAA
AGCACAATCATTGAGAAAGATGGTGCGTGGCTTCACGAGCTTGCTAT
GAACAACACAGTCCTTGAGACTTTAAATTTTTACATGACAGAGCTAT
CCAGTTTTAGTGTCCAGGACCTTCAAATTATTGCCAGAAATTGTCGA
TCGTTAACATCTGTGAAAATTAGCGATTGCGAAATTCTGGATCTTGT
GGGTTTCTTTCAAGATGCAGCTGCTTTAGAAGAATTTGGTGGAGGTC
TTTTTAATGAGGAACCAGAAAGGTATGCTGCTTTATCGTTCCCAGCA
AGATTATGCCGTTTGGGTCTAACCTACATTTCAGAGAATGAGATGCC
TATCGTGTTCCCTATTGCATCTCGGCTAAGGATGTTAGATCTTCTCT
ATGCATTTCTTAGCACAGATGACCTCTGCTTGCTGATTCAGCAATGC
CCCATCTTGGAAGTTCTTGAGACAAGGAATGTCATTGGAGACAGAGG
ATTAGAGGTTCTTGCTCATAGTTGTAAAAGGTTGAAGAGGCTTAGGA
TTGAAAGAGGTGCTGATGAGCAGGGTATGGGGATGAAGGAGGCCTT
GTTTCGCAAAGAGGATTAATGGACTTGGCTCGGGGCTGCCTAGAACT
GGAATACCTGGCTGTTTATGTATCTGATATCACAAACTCATCCCTCG
AATGTATAGGAACTTATTCGAAGAACCTTTGTGATTTCCGTCTTGTT
CTACTTGACCGCGAGGAAAAGATAACTGATTTACCCCTGGACAATGG
TGTCAGGGCTATTTTAAGGGGATGTGAAAAGCTAAGAAGGTTTGCTC
TTTATCTGCGGCCTGGGGGCTTGACAGATGTGGGTCTTGGTTACATT
GGGCAGTATAGCCAAAACATAAGATGGATGCTTCTTGGATATGTGGG
AGAGAGTGATGAGGGCCTTAGGGAGTTCTCCCGAGGCTGCCCGAGTT
TGCAAAAACTTGAAATGCGGGTTGTTGCTTTAGCGAACAGGCGCTG
GCTGATGCTGTGATGCGGTTGACTTCTTTGAGGTATGTCTGGGTGCA
GGGGTATAGAGGATCTGACACCGGTCGAGATATTCTGGCGATGGTCC
GTCCCTTTTGGAACATCGAGTTGATTCCTGCTAGAAGAATAGCTGTT
GCCAATCAGAATGGGAAAACGTGCTTAATGAAGACCCAGCCCATAT
ACTTGCATATTACTCTAGCAGGACCAAGAAATGATTGTCCTGACA
GCGTTATACCTTTGGCTCCAGCAAGGCTGCTTACCTTGTAGAGCTGT
ATATACACCCTTTTGCCGAAGATGTCTTTTATCTTCTTAAGTGCTCT
AGACCCCCTGTCATACGGTTCTGTATTTTATCACTCCTCCCTGAGAA
ATTTCTCCTCTTGCTTTACTTTTCGTCTTCCGTTTGTTGGAATTCCT
TCTTTTCTCTTTTATTTTGTCGCAATAAGATTGTGTACTTTGTAAAA
AAAAAAAAAAAAA |
| 32 | AGGTTTGGGTTTTTTTTTTTTTAGGGGCGATCGGGGATGGCGA
ACCGGGTGGATCACGAGTACGATTACCTGTTCAAGATCGTCTTGATC
GGGGACTCCGGCGTCGGCAAATCGAACATCCTCTCGAGGTTCACGAG
GAACGAGTTCTGCCTGGAATCTAAGTCCACCATCGGCGTTGAGTTCG |

TABLE 2-continued

Cell Signaling Gene Sequences

| SEQ ID NO | Sequence |
|---|---|
| | CGACGAGAACCCTGCAGGTTGAGGGAAAGACCGTCAAGGCACAATAT<br>GGGATACTGCTGGTCAAGAGCGATATCGAGCCATTACCAGTGCATAC<br>TACAGGGGAGCAGTGGGCGCTTTGCTAGTTTATGACATAACAAAGAG<br>GCAAACCTTTGACAATGTCCAGAGGTGGCTTCGGGAGCTGAGGGACC<br>ATGCAGATTCTAACATAGTTATTATGATGGCTGGGAACAAGTCTGAT<br>TTGAACCACCTAAGAGCTGTCCCGGGGGACGATGGTCAAGCCCTGGC<br>TGAGAAGGAGGGTCTTTCATTTCTTGAGACTTCAGCATTGGACGCAA<br>CAAACATTGAGAAGGCGTTTCAGACAATTTTGACAGAGATCTACCAC<br>ATCATAAGCAAAAAGGCATTGGCAGCTCAGGAAGCTGCTGCTACTAC<br>GCTTCCTGGTCAAGGGACCACAATTAATGTCGCTGATGCCACAGGGA<br>ATGCCAACAAGAGAGGCTGTTGTTCTACTTAAGGCGACACTGTGATT<br>CAGGAGACAAAATTTGAGTGGTAATTAACCCCAGCAGCTTAGATATG<br>AGCCCATTTTCTTTTGGGTCAACGAGACATTTGTAGAATATTTGTGG<br>TGTTCTTTTCCTCCCCCGTTTTATTTTTCTTTTTACTC |
| 33 | GCCTCGTGCCGAATGCAAGGCAAACAAGCAAGTGCATTATCTTCGTT<br>CTGAGTGAGAGAGAGAGAGAGAGAGACCAAAAGACAAGCAAGGTTTC<br>ACTACAGCTTCTAGAGAGAGAAAATGGAGAGCTTCCCAGTGATCAAC<br>ATGGAGAACTTGAATGGTGAGAAGAGAGCAATCACCATGGACAAGAT<br>CAAAGATGCTTGTGAGAACTGGGGCTTCTTTGAGCTGGTGAATCATG<br>GGATTCCACCCGAGTTTATGGACACGATCGAAAGCATGACAAAGGGG<br>CACTACAAGAAGTCATGGAGCAGAGGTTCGGAGAGCTGGTGGCGAG<br>CAAGGGGCTCGAGTGTGTCCAGACAGAGGTCCACGACTTGGACTGGG<br>AAAGCACCTTCCACTTGAAGCACCTTCCTGTCTCTAACATCTCCCAA<br>ATCCCAGATCTCGATGATGACTACAGGAGAGTCATGAAGGAGTTTGC<br>ACTGAAATTGGAGAAGCTGGCGGAGGAGCTCATGGACCTACTGTGTG<br>AGAACCTGGGCCTGGAGAAAGGCTACTTGAAGAAGGCCTTCTACGGG<br>TCCCAAGGACCGAACTTCGGCACCAAGGTTAGCAACTACCCGCCGTG<br>CCCGAAGCCCGACCTGATCAAGGGGCTCCGGGCCCACACCGACGCCG<br>GTGGCATCATCCTGCTCTTCCAAGACGACAAGGTTAGCGGCCTGCAG<br>CTCCTCAAGGATGGCCAGTGGGTTGACGTCCCCCCAATGCGCCATTC<br>CATCGTCGTCAACCTCGGAGACCAAATCGAGGTGATAACTAATGGAA<br>AGTACAAGAGCATACTGCACAGGGTGGTGGCCCAGACCGATGGAAAC<br>AGGATGTCCATAGCTTCATTCTACAACCCAGGCAGCGACGCCGTGAT<br>CTATCCGGCACCGGCACTTGTGGAGAGCGAGGCAGAGGAGGCCAGCA<br>AAGCAGTTTACCCAAAGTTCGTGTTCGAGGACTACATGAAATTGTAT<br>GCTGCTCTCAAGTTCCAAGCCAAAGAGCCAAGGTTCCAAGCCATGAA<br>AGCCATGGAGTCGAGCCCCAGTTTGGGCCCAATCGCAACCGCTTGAT<br>TTGGAGAATTTAGGACTTCTCTAAGTGTGGACGCAGAAGAATAAATT<br>GGCTTTTTTTTTATTATTATTTTTAGGTTATGATTGGACCAACTGAG<br>GAGATTCTATCCATCAGTTTAAGTACATATTTGAACTCTGTCCCAAT<br>ATGTACTTTGATTTATGGATTGTAACGATGTACTCAATTGGAAATAA<br>TAGGAGCGAAAGATCATTTAAAATAAAAAAAAAAAAAAAAAAAAA |
| 34 | GAGAGAGAGAGAGAGAGAGAGAGAGAGAGACCAAAAGAGAAACAAGG<br>TTTCACTGCAATTTCTCAAGAGAGAAATGGAGAGCTTCCCAGTGATC<br>AACATGGAGAACCTGAATGGTGAGAAGAGAGCAATCACCATGGACAA<br>GATCAAAGATGCCTGTGAGAACTGGGGCTTCTTTGAGCTTGTGAATC<br>ATGGGATTCCGCCCGAGTTCATGGACACGGTCGAGAGAATGACCAAG<br>GGGCACTACAGGAAGTGCATGGACCAGAGGTTCAGAGAGCTGGTGGC<br>GAGCAAGGGGCTCGAGAATGTCCAGACGGAGGTCCATGACTTGGACT<br>GGGAAAGCACCTTCCACTTGAAGCACCTCCCCCTATCCAACATCTCC<br>CAAGTCCCTGATCTCGAAGATGACTACAGGAAAGTCATGAAGGAGTT<br>TGCAGTGAAGTTGGAGAAGCTAGCGGAGGAGCTCATGGACTTGCTGT<br>GTGAGAACCTGGGCCTGGAGAAAGGTTACTTGAAGAAGGCCTTCCAC<br>GGGTCCAACGGGCCGAACTTCGGCACCAAGGTCAGCAACTACCCGCC<br>GTGCCCCAAGCCCGAACTGATCAAGGGGCTTCGGGCCCACACCGACG<br>CTGGCGGCGTCATCCTGCTCTTCCAGGATGACAAGGTCAGCGGCCTA<br>CAGCTCCTCAAGGACGGCCAGTGGGTTGACGTCCCCCCGATGCGCCA<br>CTCCATCGTAGTCAACCTCGGCGACCAAATCGAGGTGATAACCAATG<br>GGAAGTACAAGAGCGTGCTGCATAGGGTGGTGGCCCAAACTGACGGG<br>AACAGGATGTCCATAGCTTCATTTTACAACCCGGGCAGCGACGCCGC<br>GATATATCCAGCACCGGCACTCATGGAGAGCAAGGCAGAGGAGGCCA<br>GCAAAGCAGCTTATCCAAAGTTTGTGTTCGAGGACTACATGAAACTG<br>TATGCTGCCCTCAAGTTCCAGGCCAAAGAGCCAAGATTCCAGCCATG<br>AAAGTCATGGAGTCGAGCCCCAATTTGGAGCCTATTGCAACCGCTTG<br>ATTTGGGAATTCTTTTTCGCAATTCTTTGCTTGCAAAAGATGTAGTC<br>ATACACATTATGGAAGTCCTCTAGGGTTAGAAAGGACTCTGAATTTT<br>TTGGTGGTGGAAGGAAATTTTTTCCTACCCCAAACTTGATAAAAATT<br>GTCATTGTGACTCATGTTAGTATTTGACATGATTCGTGTTAAATTAT<br>TTATGAAATATTGCATGTTATAGTCAAAAAAAAAAAAAAAA |

TABLE 2-continued

Cell Signaling Gene Sequences

SEQ
ID
NO  Sequence

35  GCGAGGACATCATCACCAACGCCGCCATCGAAGAAGGGGCGAATCTG
    AAGCGAAAGAAGAGATGAGCGGCGGCAGCGACCTCCCTGAAGAGATC
    CTGATCCAGATCCTCCTGAAATTGCCCGTCAAGTCACTTGTACGATT
    CCGATGCGTCTCCAAGTCGTGGGACTCCCTCATCACCCACCCATCCT
    TCGTCTCCCTCCACCTCCGCCACGCCATGGCGGGCCACGACCGCTCC
    GTCATCCTCCTCCGGCACTACTCCCTCACCCAGCGCAAGGAGCGGAA
    CACCCTCTACCTCGACGGGGAGTCTTTCTTGGAGCACCAGGAGCTCG
    AATTCCCCTTGAAGACCCACGACACTTACTACCTCGCCGGCTCCTGT
    AATGGGTTGCTCTGCTTTTCCGACTATATCATCAACAACCTCCAGGT
    AATCCTCTGGAACCCTTCCCTCAGGAAGTGCGTGCAGTTGCCGATCC
    CGCGGTTCATTGATACTGATCTCACGCACACGTATGTTCTCGGGTTT
    GGGTTCGATACGCGGCGTGTCGATTACAAGGTCGTGAGGTTGATTTA
    CATTCTGGGGAAGAATTGGTCCGTGATAGTGCCACCGGAGGTTGAGA
    TCTATGAGCTTAAAACTAATGCTTGGAGAGGGATCCAGACGGCCGTT
    CCTTATGTCATACCAGAATCTTCGTCGCAGGCCTTTGTGAATGGGGC
    TATCCATTGGATTGGGTATAACCCAGCTGATAGGCGATTGAAGGTGG
    CTTCAAGTCCTAGGTCGATTGTGGTATTATTCGATATGCAGGACGAG
    GTGTTTGGGGAAATGGAGTTGCCGAAAGGTGGGGATTATGCGAACAG
    GCTGAATTTGTCGCTGGCTGTGCATCAAGATTTGATTTGCTTGTTGC
    ATTGCCATCCGATGGAAGAAGATGGGCATCAGTTGTATGGGGTTTGT
    TGGGTCTGGGTCATGAAAGAATACGGCGCAGCAGACTCCTGGACTAA
    GCTGTTTACCATTAACATCAGTGAACACGGCGGGATCGGGAGGATTT
    TAGGTTTTAGGAAAAAGGGGGACGCTCTGCTCGTGACTCACAATGAC
    GAGCTGGTTTCATATGACTTGAGGGGTCAGAGAATTAGTCGGCTTGG
    ATTGTATGGTGTTGCGAGATCTTTTGAAGTCATCCCATACATGGATT
    GTCTAATTTTAGTGTGAGGAGAGCACACACTCTCCAGACAACCATAT
    TTCATGGCTGGTTAGGTTGTAGGTAGATTATGTTGGATTTCGCTCTC
    CTGAAGGAGTGAAGCATATGACACAATAATGGAGAACCAGAGTGAT
    TAGAGATACTTAGACTTTAGTTGTTGTATACGGGTTGATTGCTGTTT
    TCTCTAGAAGTTATTCTGGACTAGTGAAGTATGTCCTTTTACTTATC
    TGAATGATTTTTATTTTTGGGAGTTTCAGATGGTTGATTGGATGT
    ATGCTACTGAAAGTTGGGGCTTCTATTGCTACTGCCAGTTGCCCTAG
    CAGAAGAATGATAATAATTTCTTTGTTCCAAAAAAAAAA

36  CCCGTAGCGTCGACCACGCCAACTACCTTTCATTCGTGCCCGTCGAT
    ACTCCAACGAACTCCAGTCCTCCTCCCCCTCTCCGTCTCGGTCGCGC
    TCCCCGCACGCCGACCTTCGATTTCGACCAGCGGTTCTCTCGAGCTC
    CCGCGCGTCCGCCGATCCGAGCGTCCGCCGGATTCACCTCGTCGGAG
    CCGCCATGGGTTGCTCCTCTTCGCTTCCAGATAGGGCTTCTGGGAGA
    TTGGGCGGGCTCAATTCGGAGAACGGTGCAGTGAACGACGCGAAGAA
    CCTGCGTGTTAAGCTTGTACTTCTAGGGGATTCTGGTGTTGGGAAAA
    GTTGCATTGTACTTCGCTTTGTCCGTGGTCAGTTTGATCCGACATCT
    AAGGTGACTATTGGAGCATCGTTCCTGTCACAGACCATAGCTTTGCA
    AGATTCTACGACAGTTAAGTTTGAAATATGGGACACTGCTGGTCAAG
    AGAGGTATGCTGCCCTGGCCCCACTTTACTATCGGGGTGCTGCGGTT
    GCGGTAGTGGTTTATGATATAACAAGCCCGGAATCATTTCAAAAAGC
    TCAGTACTGGGTCAAGGAGCTTCAAAAACATGGAAGCCCTGATATGG
    TTATGGCTCTGGTTGGAATAAAGCTGACCTTCAGGAGAATAGAGAAG
    TGACGGTCCAAGATGGGATTGACTATGCTGAGAAGAACGGCATGTTT
    TTCATTGAGACATCTGCTAAAACTGCAGATAATATAAATCAGCTGTT
    TGAGGAAATTGCCAAGCGACTTCCACGTCAACACCGTCATGATTGG
    GAAGTTCATACCGTGTTTAAAGCCGCAGATGATGTTATTGGAGTCTT
    CAACGGCGGTGATGTAAAATATCTATCCCAATGTATACCTCCTGTCC
    TGGAATTCTTTGGTCGACAGTTACTTTCATTTGTCCATGAATTCACT
    CCACATAAGTTGTAAGATGATCAATCCTCAATTGTACCAGAGAGAGC
    TTGCGAAAAAAAAAA

37  GCAGCAGCAGGCGCAGCAGAAAGGAAACAAAAACAGGGAGGAAAGGA
    AAACGACCTTTCCCACTCAAAAGCTCCTCCCTTTTTCATTTGCATTT
    CTGCATCCACACAGGCACAGGGAGACAAGGGGACCGAGTCAGTGAGT
    CGGAACGGTTGACCGCGGAATCTCCCCCCCCCAACAAAAAGCCATCG
    CCCAACTCAGGCCAACAGTCAAAACCCACCTTAACCGAATTCCCCCA
    GATCAATCCCCTCTCTCTCTCCTCCACTGTAACGGAATCGCGACC
    CCCAAATCCTAGGGCTTTCTTTCTCTCTCTTTCTCTCTCTATTTCTA
    CCACCACCATCACCACCACCGATGGACGGCGGGGCTCCTCAGCCGGC
    GGATACCGTCATGTCGGAGGCGGCGCCGGCGCAGCAGCAGCAGCAGC
    AGCCGCAGCAGGCGCAGCCGCAGGGGATCGAGAACATCCAGCGACG
    CTCAGCCACGGGGCCGCTTCATCCAGTACAACATCTTCGGCAACAT
    CTTCGAGGTCACCGCCAAGTACAAGCCCCCATCATGCCCATCGGCA
    AGGGCGCCTACGGCATCGTATGCTCGGCTTTGAATTCGGAGACGAAC
    GAGCACGTGGCCATAAAGAAGATTGCTAATGCTTTCGATAACAAGAT
    CGATGCGAAGAGGACTCTCCGTGAGATCAAGCTTCTCCGGCACATGG

TABLE 2-continued

Cell Signaling Gene Sequences

| SEQ ID NO | Sequence |
|---|---|
| | ACCATGAAAACGTTGTGGCAATTAGGGATATCATTCCACCGCCACAG<br>AGAGAGGTGTTCAATGATGTTTATATTGCATATGAGCTTATGGACAC<br>TGATCTGCATCAAATTATTCGTTCCAACCAAGCATTGTCTGAGGAGC<br>ATTGTCAGTATTTTCTATATCAGATCTTGCGAGGATTAAAATACATA<br>CATTCTGCAAATGTTCTGCATAGAGACTTGAAGCCCAGCAATCTTCT<br>CCTAAATGCAAATTGCGATTTGAAAATATGTGATTTTGGACTAGCTC<br>GTGTCACTTCTGAAACTGATTTTATGACAGAATATGTTGTCACAAGA<br>TGGTACCGTGCACCAGAGCTATTGTTAAATTCTTCAGACTATACGGC<br>GGCAATAGATGTATGGTCTGTAGGCTGTATCTTTATGGAACTAATGG<br>ATCGGAAACCCTTGTTTCCTGGCAGAGACCATGTGCAACAGCTGCGT<br>TTGTTGATGGAGCTGATTGGCACCCCATCAGAGGCAGAGTTGGGGTT<br>CTTAAATGAAAATGCTAAGAAGTATATCAGACAGCTTCCTCTGTACC<br>GTCGGCAATCTTTCACTGAAAAGTTTCCCCATGTCCACCCACTTGCA<br>ATCGATCTCGTTGAGAAGATGTTAACGTTCGATCCCAGGCTGAGGCT<br>CACAGTTGAAGAGGCATTGGCTCATCCCTACCTAAACTCACTGCACG<br>ACATCAGCGATGAGCCGACTTGCATGAATCCATTCAACTTCGACTTT<br>GAGCAGCATGCACTCACGGAGGAACAGATGAGGGAGTTAATTTATAG<br>GGAAGCGCTTGCATTTAATCCCGAGTATCTACAGTAATGGAAGTCAT<br>GCTGTTAGTATTTGGTGGCTGTTCTCGAGTGTGATGCCCGCGCTTTA<br>ACATGGCGATGATTTATTTCTTCATGTACATATGGTTTATCCTATTG<br>TTGGATGGCTCTGCTATTGAATTCTTTTCATGACTTCGAGAACCATA<br>AGAATTTTCAAAAAAAAA |
| 38 | TTCCCTCTTCCTCTTCCCTTCCGTTTCGAGCTCGCTCCATCTCCTCC<br>GACGAAAGATCCGAGCCCCCTCCTCCTCCCCCAGCACCATCCGGGCC<br>CGATTCGGGTCGGGTCGGGTCGTCCGGAGCGGACCCTCTCCTCCGCG<br>CTCTCCTCCGATGGAGTCGTCGAGCTCGGGAGGTGCCTCGGCGGAGC<br>ACAGCGTCCGCGGGATCCCCACGCACGGCGGGCGCTACGTGCAGTAC<br>AATGTGTACGGGAACCTCTTCGAGGTCTCCAGGAAGTACGTCCCCCC<br>GATCCGCCCCATCGGCCGCGGCGCCTACGGTCTCGTCTGCGCTGCCA<br>TGAATTCAGAGACAAATGAGGAGGTTGCCATCAAGAAGATTGGCAAT<br>GCGTTTGACAACAGAATAGATGCCAAGAGGACTTTACGAGAAATTAA<br>GCTTTTATGTCATATGGATCATGAGAATGTTATTGGCCTTAAAGACA<br>TTATACGTCCACCAAGTAGGGAGAACTTTAATGATGTTTACATTGTG<br>TATGAATTGATGGACACTGATCTCCATCAAATTATCCGTTCCAATCA<br>GCCATTGACTGACGATCACTGCAGGTACTTCTTGTATCAGTTGCTTC<br>GAGGTCTCAAATATGTGCATTCAGCAAGTGTTCTGCATCGCGATCTG<br>AAGCCAAGCAACTTGTTTCTGAATTCGAATTGTGACCTTAAAATTGG<br>AGACTTTGGGCTAGCTAGGACCACATCTGAAACGGATTTTATGACTG<br>AGTATGTAGTTACTCGCTGGTATCGTGCACCAGAACTGCTCCTTAAT<br>TGTTCAGAGTACACTGCTGCGATTGATATTTGGTCTGTGGGTTGCAT<br>ACTTGGTGAAATTATGACTAGGCAGCCCCTATTTCCAGGCAAAGACT<br>ATGTCCATCAGCTGAGACTTATTACAGAGCTTATAGGATCTCCTGAT<br>GACTCCAGCCTTGGGTTTTAAGAAGTGATAATGCACGAAGATATGT<br>AAGACAGCTTCCACAGTACCCAAGACAGCAATTTTCTAGTAGATTTC<br>AGACTATGTCTCCAGGTGCTGTTGATCTCCTAGAAAGGATGCTCGTC<br>TTTGATCCCATCAGGCGAATAACAGTTGAGGAGGCTTTGTGCCACCC<br>TTATTTGGCCCCTCTACATGATATAAATGAGGAACCCATTTGCCCGA<br>CTCCCTTCATTTATGACTTTGAGCAACCGTCATTTACTGAAGAAAAC<br>ATTAAGGAGCTCATTTGGAGGGAGACTCTGAGATTCAATCCAGATCC<br>CATGCATTAGGGATTTGCGACAGGTTGTCGCTTTGTTTAGTAATGTT<br>CTACACTTAACTGGTTGGATGTTTCATTCAAAAAATGAAACAAGTGT<br>GCTGTAGATAGCGAAATTAGTTTTGAAGTTTTCTACACAGCTGGACA<br>AAAGTTCTTTGAGCTTGGATGCTATGTATGCTTGTAATGTTCAACTT<br>GTTCAGCCGATGATAAAAGGTCTTCACTCTTGAGGCTTAAAAAAAAA<br>A |
| 39 | GCCCAAGTTCGCATCTTTCGTCCTTTCCCCACGTACCCATTTGCTCA<br>TTCCGCCGGAATTCGGCCGGAATTCCTCCCCCGCCGCCGCAATGGGG<br>CAGGTCCCGTCTTCCGCCTCCTCCTCCCCCGAGCCCAGCCACCGCGG<br>CGGCGCGATCTCGTCCAGCCACCGCCTCGACTCCCTCCCCTCCCTCG<br>AGTTCGTCTCGTCGTTCGAGGACGAGGAGGACGCCGCCGCCGCCGAC<br>GAGGGGGCCGCCGCTGGGTACGACTACACCGGCGACCTCCCCGACGA<br>GTGCCTCGCCCACGTTTTCCACTTCCTCGGCACCGGCGACCGGAAGC<br>GGTGCTCCGTCGTGTGCCGGCGGTGGCCGCGTCGACGGGGAGAGC<br>CGGCACCGGCTCTCGCTGAACGCGCAGGCCGACCTGCTCTCGTCGCT<br>CCCCTCCGTGTTCTCCCGCTTCGACGCCGTCACGAAGCTCGCGCTCC<br>GGTGCGACCGGAAGTCGGTCAGCCTGGGCGACGAGGCGCTGGTCCTG<br>ATCTCCCTCCGGTGCCGCGGCCTCGCCCGGCTCAAGCTCCGCGGCTG<br>CCGCGAGGTCACCGATCTCGGGGTCGCGGCCTTCGCCGAGAACTGCC<br>GGCAGCTGAGGAAGCTCTCCTGCGGGTCGTGCTCGTTCGGCGCGAGG<br>GCCATCAATGCGGTGCTCGACCACTGCGTGAATCTGGAGGAGCTGTC<br>CATCAAGCGCCTCCGGGGAATCCACGACGGCGCCGAGCCCATCGGGC |

TABLE 2-continued

Cell Signaling Gene Sequences

| SEQ ID NO | Sequence |
|---|---|
| | CGGGAGCCGCGGCGAAGTCGCTGAGATCCATTTGCTTGAAGGAGCTC ATCAATGGTCAGTGCTTCGGTCCTCTCCTGGTCGGAGCGAGAAAGCT CTCGACTTTGAAGTTGATTCGCTGTCTGGGCGATTGGGACAATGTTC TCCAGACAATTGGGAGCTCAAATCCAGGTCTATTAGAAGTTCATTTG GAGAGAATTCAGGTGAGCGATGGCGGTCTTTGCGGGATCGCGAACTG CAAGGGTATCGACAGTCTGCATGTCGTGAAGGTCCCCGAGTGTTCGA ATTTAGGTCTTTCTAGCATTGCTGAGAATTGCAGGCAATTGAGGAAG CTTCACATTGATGGGTGGAGGATAAACAGGATAGGCGACGAGGGTCT GGTCGAGGTCGCCAAGCAGTGCCTCCAGTTGCAGGAGCTGGTCCTGA TCGGCGTCAGCGTGACCCATTCTAGCTTGGCCGCAATCGGTTCCAAT TGCAGGAAATTGGAAAGGTTAGCCTTCTGTGGGAGTGACACGGTCGG TGATGCGGAGATTGCGTGCATTGCCGCCAAGTGCGAGGCCCTGAAGA AGCTCTGCATTAAGAATTGCCCCATTACTGATGTCGGGATCGAATCC CTTGCTCAGGGGTGTCCCAATCTGGTGAAGATTAAGGTGAGGAAGTG CAGGGGAGTGAGCGGGCAAGTGGTGGAGCTGTTGAAGGAGCGGAGAG GGTCGCTGGTCTTCAATTTGGATGCCTGTGGAATCGAAGCATTGGAC GATATCAGAGGAGTTCAAGAAAGTGTTATGGAGTTCCCTCCTGTGAA TACTTCCGATGCGCCGTCGAGTAGCAATGAGAGGTCAATGTTGTTTA GGGCGAAGCTAGGTCTTTTCGCGGGTAGGAATTTAGTGGCCTGCACC TTCAGGAGGTGGTCAAATGGTGAACATAGCACCAATGGAAACTTGTG AATTCCAATTGTTGTAAGCGCTGAAAATTGTTTTGTTGACATTTCGT TGTGTTTAGACCTTCCCTAGGCAATTCTTGTTCGCAATGATGTACCT ATTATCGCCCTTTTGCCTCGTGCAACTTTTCTTGGAAATGAAACTCG AGTTCTTTTAAAAAAAAAA |
| 40 | GGCTCCAAAACAACCAAATAACTCACACTGAGCTCTTCCTCCTCCTC CTCCTCCTCCGCCTCTATATGGCCGTCCAGATCTAAACACCACTTCT GCCCTTCTCTCTCTCTCTCTCTCTTGCCTTTCCCTCGGAGCCAAT CAAGAAGAAGCTAGAGCTCCGGTCCTCGCTCCCGAGATTCATGGCGT ACTCGTTCCCGGAGGAGGTGCTGGAGCACGTGTTCTCCTTCATCGGC TCCGACCGGGACCGCAATGCCGTCTCCCTGGTGTGCAAGTCGTGGTA CGAGATCGAGCGCTGGTGCCGGCGGCGCGTCTTCGTCGGCAACTGCT ACGCCGTCAGCCCCGCGGCCGTCGTCCGGCGCTTCCCGGAGGTGAGA TCCGTCGAGCTCAAGGGCAAGCCCCACTTCGCCGACTTCAACCTCGT CCCCGAGGGCTGGGGCGGCTACGTCTCCCCCTGGATCACCACCCTGG CCCGCGCCTACCCTTGGCTCGAGGAGATTCGGCTCAAGCGGATGGTG GTCACCGACGAGAGCTTGGAGCTGATCGCCCGCTCGTTCAAGAACTT CAAGGTCCTGGTTTTGTCCTCTTGCGAGGGGTTCTCGACCGACGGGC TCGCCGCTGTTGCCGCTAATTGCAGGAACTTGAGGGAGCTTGACTTA CGGGAGAGTGAAGTGGAAGATATGAGTGGACATTGGCTCAGTCATTT CCCTGATTCATATACATCACTCGTATCCCTCAACATTTCCTGCTTAG GCTCTGAGGTAAGCTTCTCTGCCTTGGAGCGCCTGGTGAGTCGCTGC CCCGACCTGAGGTCTCTCCGACTCAACCGCACCGTGCCACTTGATCG CCTTGCCAATTTACTTCGACGGCCCCCACAGTTGGCTGAATTGGGCA CGGGCGTTTATTCTGCTGAACTGAGGTCTGATGATTTCTCGAATCTA GTTGGTGCTCTAGCTGGCTGCCGAGAGCTGAGAAGTCTGTCTGGATT TTGGGATGTGGTACCTGCATATCTTCCAGCTGTATATCCCCTATGCT CAGGGCTTACATCGTTGAACTTGAGCTATGCTACCATCCAAAGCTCT GAACTTACAAAACTTATCAGTCAATGTCACAGTCTGCAGCGCTTATG GGTACTTGATTATATTGAAGACAGCGGTTTGGAAGCCCTGCTGCAT GTTGCAAAGATTTACGGGAATTGAGGGTGTTTCCCTCTGAGCCCTTC AACCGTGAAGGAAATGTATCTTTAACGGAGCAGGGCCTTGTGTCAGT GTCTGAGGGTTGCTCCAAGCTTCAGTCAGTTTTGTACTTCTGCCGCC AGATGTCTAATGCGGCCTTACTTACCATAGCTCGGAACCGTCCTAAC ATGACTCGATTCCGACTTTGTATCATTGAACCACGTTGTCCTGATTA TATAACTCATGAGCCACTCGATACAGGCTTTGGAGCCATTGTCCAAC ACTGCAAGGATCTCCAGCGTCTCTCTCTATCAGGTCTTCTAACTGAC CGTGTGTTTGAGTACATAGGGACTTATGCAAAGAAACTTGAGATGCT TTCTGTGGCATTCGCTGGAGACAGTGACTTGGGACTGCACCATGTGC TATCGGGTGCGACAGTCTTAGAAAATTGGAGATCCGGGACTGCCCG TTTGGTGACAAGGCGCTTTTGGCCAATGCTGCAAAGCTGGAGACAAT GCGATCCCTTTGGATGTCTTCTTGCTCAGTGAGCTTCGGAGCATGTA AGCTGCTTGGTCAGAAGATGCCCAGGCTTAATGTCGAAGTCATTGAC GAGAGAGGCCACCCGGATTCAAGGCCTGAAAGCTGCCCGGTCGAGAA GCTTTACATCTATAGAACGGTTGCAGGTCCGAGGTTCGACATGCCTG ATTTTGTTTGGACAATGGATGAGGATTCTGCTCTGAGGCCTTCTTGA CAGCTTTCATTCAACCGTTTGCTTTTTTTCCTCGTGGCACTATGGTG TGGTGACTGTGACAGTCAAAGCAGGTACATGCTCTTCACCGCCCTCT TTCATGCAGGTCTAATTTCTTTTTAGCTTAGTATTAGCAGCTGTTAT TGGTGGTGACATTAGCTGTGGGAAGGGTATATGGAGGCTCAAGAGCT CTTTAGCCGAAGATTTTGCACTTGGCTGAGCTATGGATACCAATGCA TTGTTAAATAAAAGAGGACCCTTTTTGCTTTTGCTGTTGTTGTTGTT |

TABLE 2-continued

Cell Signaling Gene Sequences

| SEQ ID NO | Sequence |
|---|---|
|  | ATTGTTGCTGTTGTATGTGTATCAAGACATGGTTATTTAATTTGGGT<br>TAAAAAAAAAA |
| 41 | CTCCTTCTTCTTCCTCTTCTCTCTCTCTTTCCCCCCAACATTTTCAC<br>GAACACCTGCCGGACGGAGAGAGACCTGCAGCTGGGTTGCCGGAGAG<br>GAAGAGGGAGAGAGGGACAATGGCGCAGTACGAGGAGGACAACGCCG<br>AGTTCTACGTGCGGTACTACGTGGGCCACAAGGGGAAGTTCGGGCAC<br>GAGTTCCTGGAGTTCGAGTTCAGGCCCGACGGGAAGCTGCGGTACGC<br>CAACAACTCCAACTACAAGAACGACATCATGATCCGCAAGGAGGTCT<br>GGCTCACCCCCGCCGTCCTCCGCGAGTGCCGCCGCATCATCTCCGAG<br>AGCGAGATTATGAAGGAAGATGATAGTAACTGGCCAGAACCTGACCG<br>TGTGGGACGGCAAGAACTTGAGATTGTAATGGGGAATGAGCACATTT<br>CCTTCACTACCTCAAAGATTGGTTCCCTTGTTGACGTGCAGACAAGC<br>AAGGACCCTGACGGGCTTCGGATATTCTACTATCTTGTTCAGGACTT<br>GAAATGCTTTGTGTTCTCTCTCATCTCCCTCCACTTCAAGATCAAGC<br>CAATCTAAGGAGGACTTCTTCCAAGCATCTGAATCCCAATTGTTTGA<br>TCCTTTTGGCGGTAGCCTCGTGGTCTGTCATTGATTGAGCAGCATGC<br>ATATTGTGGTATTGTGCACTTTGAGTATTGACTGGTGGAATCTCCTT<br>GTTGAGTTTTGGGTTTGTAACTAAAAGATGCTTTTAACTCGAAATGC<br>CAGACACCTCTCTCTCTCAAAAAAAAAA |
| 42 | GGCATTGTTCCTTCGCAGTCGAGTCGAGTCGAGTTCGCTTCCCGCTG<br>CCGCTGACGAAGGGTCCCATCTGCTCCTGCTCCTGCTCCTGCTCCTG<br>CTTCGGCTTCATCCCGCTCTCCTTTTCTCTGCTTCTTCTTCTTCTTC<br>GTCTTCTTCCGACCAATCCCCCAAAAGAGAAGAGGAGGAAGAGGGAG<br>GGATAAAGTAGGGGGAGGAGGGGTTGGAAATGGCGAGGAGAGCGGAG<br>GAGGAGTACGATTACCTGTTCAAGGTGGTGCTGATCGGCGATTCCGG<br>GGTCGGCAAATCCAACCTCCTCTCCCGATTCACTCGCAACGAGTTCT<br>GCCTCGAGTCCAAATCCACCATCGGCGTCGAATTCGCCACCCGCACC<br>CTCCAAGTTGAGGGAAGGACTGTTAAAGCACAGATATGGGACACCGC<br>TGGCCAGGAGCGATACAGAGCGATCACCAGCGCCTACTACAGGGGTG<br>CCCTTGGGGCTCTTCTTGTATACGATGTGACAAAGCCGACTACTTTT<br>GACAATGTGAGTCGATGGCTGAAGGAGCTGAGGGATCATGCCGATTC<br>CAACATTGTCATCATGCTAATTGGGAACAAGACTGACTTGAAGCACC<br>TTAGAGCAGTGGCTACTGAAGATGCCCAGAGTTATGCCGAGAAAGAG<br>GGCCTCTCGTTCATCGAGACATCTGCCCTGGAAGCGACCAATGTGGA<br>GAAGGCTTTCCAGACTATTCTCTCAGAGATATACAGGATAATTAGTA<br>AGAAGCCTCTGTCCTCAGAAGATGCAGCCCCGGCCAACATTAAAGAA<br>GGGAAAAACCATTGTAGTTGGCGAATCAGAAGCCAACACGAAGAAGGC<br>ATGCTGCTCTTCGTCTTGAAGATCATCCTATGTTCTTTTCCCTTACC<br>ATTGTGGTCCTTGTTTCCTTAGTTTCTCTGCTGGTTTATATGTTGTC<br>TCCAATTTGTTTTTCTTCTTTCTTTTCCAATTTTTTGACTG<br>TTTCCAAGATTATTATTGGGTCATTTGACGAAAAAAAAAA |
| 43 | GCTTTTCTTTTATCCCAACTCTCAAATTTATTCCCCGCCCACTCCTC<br>CCTCATTTCCCCTGCACAGGAAAAAAGTCGGCTCACATATATAGCTT<br>CCTGAATGCAATGGCAGTTGATTGCCTCACAAGTAAAACCTCACCAG<br>CCATGCCTCCGCAGCACAAAGATGAAGCCAGAGAGGATAAAAAACAT<br>CTAGTTTTTGACGCCTCGGTGATCCGGCACCAACCCGACATCCCGAA<br>ACAGTTCATTTGGCCCGACGAGGAAAAGCCGTGTGCGAACGCCCCGG<br>ATCTCGCCGTCCCGCTCATCGACTTGGACGGGTTCCTCTCCAAAGAC<br>CCGAGTGCCTCCGAGGAGGCATCGAGGCTCGTGGGGATGCGTGCCA<br>GAAGCACGGCTTCTTCCTTGTCGTCAATCACGGCGTGGATGCTGGCC<br>TCATATCGGACGCTCACAAGTACATGGACAAATTCTTCGGGTTACCG<br>CTCAGCGAGAAGCAGAGGGCTCAGAGGAAGCTCGGTGAGCATTGTGG<br>ATATGCCAGCAGTTTCACTGGCAGGTTCTCTTCCAAGCTCCCATGGA<br>AAGAAACGCTTTCCTTCGGCTACTCCGCCGAGAAAAGCTCGGCCAAT<br>GTCGTGGAAGACTACTTCAAGAACACCATGGGCGAAGAGTTTGAGCA<br>ATCCGGGAGGGTGTACCAGGACTATTGTGAGGCCATGAGCAGACTGT<br>CTCTAGGAATAATGGAGCTGCTAGGAATGAGCCTAGGAATCGGACAGA<br>GACCATTTCAGGGAGTTCTTCGAAAGCAACGATTCGATCATGAGGCT<br>CAACTACTACCCTCCGTGCCAGAAGCCGGACCTCACCCTAGGAACCG<br>GTCCCCACTGCGACCCGACATCCTTAACCATCCTACACCAGGACCAA<br>GTTGGCGGGCTCCAAGTGTTCGTCGACAACGAGTGGCGTTCCATCAG<br>CCCGAACTTCAACGCGTTCGTCGTCAACATCGGCGACACTTTCATGG<br>CTCTATCAAACGGGCTATACAAGAGCTGTTTGCACAGAGCAGTGGTG<br>AACAGCCGAACTCCGAGGAAGTCCCTCGCCTTCTTCTTGTGCCCGAG<br>GAGCGACAAAGTGGTGAGACCACCGAGTGAGCTAGTCGCAATGTCCT<br>GTCCGAGAGCGTACCCGGACTTCACATGGCCGGTGCTCCTCGAGTTC<br>ACTCAGAAGCATTACAGGGCCGACATGAACACGCTCCGAGCATTCAC<br>CAACTGGCTTCAACAGAGAACATCTGAACCAGTTCGGTGATGAAGAT<br>TTGTCACAAGTAGAGAGATCTATTTGGAGGTCCGAAAAGTTGCGGCT<br>AACAAAGGGGTGAAAGAGCCTCTCTGCCAAAGCAAAGAAGATGACAT |

TABLE 2-continued

Cell Signaling Gene Sequences

| SEQ ID NO | Sequence |
|---|---|
| | TGACGACGACAAAGAAGAGAGATCAAAAGGGAAGTGGTGGGTTTTTT<br>TTAAAGGACGTTGGAGAGGGACAAACAGAGAGTTAGAGGAAAAGCCA<br>AAATATCTTTTACCTTCAAGGGTACGTCTTCTGTAGCCAGATAGTAC<br>TGGCACCCATGATGGTCACGATGATCAAAGGGCAAGAGATCAAGAAA<br>CATGAGAACCAATAAAGAGCTGTAATACATCAGCTAATTTTTGTTTT<br>GTTTTTTTCCTTCTCCTTTTGTCCTTGGTTAAGGTAGAAAAGTTTAC<br>CCCACAGTAACCCCTGCCTTGATGTAAATTTTGCATTTTGG |
| 44 | GCTCGTGTCCACCTACAAGTCAAATTCCGCTTCGATTGTCCGGTCCG<br>ACTCCCCGACCCAAGGAAGGAACGACGTCAAAAAAAAAAAAAATAC<br>GAACTTTCTCTGCCTCAAGACTCGCTAGGAAGTTGTCTTCTTTGAGA<br>GCTCCGATCGGCATCAATGGCTTCTCGCCGGCGCATGCTCCTCAAGG<br>TCATCATCCTCGGCGACAGCGGGGTTGGGAAGACTTCTCTGATGAAT<br>CAGTACGTGAATCGCAAGTTCAGCAATCAGTATAAGGCGACGATCGG<br>AGCTGATTTCTTGACGAAGGAAGTTCAGTTTGAGGACAGGCTGTTCA<br>CATTGCAGATATGGGATACAGCTGGCCAAGAAAGGTTTCAAAGTCTT<br>GGTGTGGCTTTTTACAGAGGTGCCGACTGCTGTGTTCTTGTGTATGA<br>TGTGAATGTAATGAAATCATTCGACAATCTAAATAACTGGCGGGAGG<br>AGTTTTTGATTCAGGCCGGTCCTTCTGACCCTGAAAACTTCCCATTT<br>GTCGTTTTGGGTAACAAGGTGGATGTCGATAATGGCAATAGTCGTGT<br>GGTTTCTGAGAAGAAAGCGAGGGCTTGGTGTGCTTCCAAAGGAAACA<br>TTCCTTACTTTGAGACCTCTGCCAAAGAAGGATTTAACGTGGAAGCT<br>GCTTTTGAGTGTATAGCCAAAAATGCTTTGAAGAATGAACCAGAAGA<br>AGAAATATATCTTCCGGACACCATTGATGTTGCGGGTGGAGCACGGC<br>AGCAGAGGTCCACCGGCTGCGAGTGTTGAAGAGTCCAACAGTACATC<br>AATTCCCTTGGGATGCGTATACGATGCGGCTCAAGGTGTATCAATTC<br>GTGTTACAGATACCATTCTCTTATGTATTGTCAAAAGCAGAGTAAAA<br>AAAAATTCTTCCTAAAGGATTGATGTAGAGAACCGTTGAACTTCCCA<br>GTGTGCATTTGTATCATAAGCCAATCAGGGAGACCTTGTTTGTTTTT<br>TCATCTTTTCACACCTATTTGGTTCCATGATATCTTTGGTCACCCTG<br>AAATTCTTAATATCTTTTCCTAAAAAAAAA |
| 45 | GGAATAAAAGGGCATCTACATTGACTTGGATCTAAAAAGATTCGATT<br>TTTTGTATTTTTCCGAGCTGAATTTCAGGAATTATAGCTTCCTTTCC<br>AGTACCCATTGAAAGAGCACCCCCGTGGGCCGTCGCTGCTCCCTCGC<br>AGATTCATGGAGTGAGAAATCTGAAGGGGAGAACGCTGATGATGCAG<br>ATCCGAATGAAACCCCACGTTGGGTTCTTCCTCCCGGTTGCCCTGCA<br>TCGATCCCTGTCGTCGCTTCCTCCGAATCCAGTCGCCTGACCCGTGC<br>AGGTACGCTCAGTGGGACATTGACCAACTCTCTTGTCCTAATTTTCC<br>ATCACAAGCTACTATATGGGAGCTAGCTAGGCACCAGAGCAGAAGGT<br>GTCTGTTCCGGCCAATACTACCTCGATTTGTCAGCTCCTATTTTATT<br>GCTTGCTTGAGAGTCTAATTCATATTCGTACATTAAACTCCCAAACT<br>CTTCCCTCGATTGCCACATCATCAACCAGCAAAGACATTCAAAACTC<br>AAAGATGCTCACCATCTCGGATGAGAAACTCTTTCACAACTGCCTGC<br>TCGCTCTCTACCTCATTGGACCGCCCACCTTCATCTCCCTACGATAC<br>ATCCAAGCCCCTTATGGCAAGCACCACCGCTCAGGGTGGGGCCCCAC<br>CATCTCCCCAGCCCTTGCTTGGTTCCTCATGAAAGCCCCACTCTTT<br>GGCTCACGCTCTTGATTTTCCCCTTTGGCAAAAACTCCTCCAACGCC<br>AGATCCCTCATTCTCATCTCCCCTTTCCTCTTTCACTACTTTCATCG<br>AACAATCATATATCCACTGCGCATCAGATCAAGCGGTGGTCAGAGAA<br>GTACTCAACCAAATGCTGCAAATCGTTTTCCGGTCACTGTGGCCTTC<br>ATGGCATTTGGGTTCAATCTCTTGAATGCTTACGTGCAAGCCAGGTG<br>GGTGTCTAATTACGAGAGTGACGGTGCTGCTGGTGGGTGGTGGTTTT<br>GGGGGAGATTCTTGGTGGGATTGGTGATATTTGTTAGTGGGATGTAT<br>ATGAACATGTCATCGGACATGGTGTTGGTGGGGTTAAAGAGGGAAGG<br>GAAAGGGTATCGAGTGCCAAGAGGAGGGTTGTTCGAGTTTGTGAGCT<br>GTCCCAATTATTTTGGAGAGATTGTGGAGTGGCTGGGATGGGCTGTG<br>ATGACATGGTCTTGGGCCGGCTTCGGGTTCTTCCTCTACACGTGCGC<br>CAACTTGGTGCCTCGGGCTCGTGCAAACCACAGGTGGTATTTGGATA<br>AATTTGGGGAGGAGTATCCCAAGAGCAGGAAAGCTGTCATTCCATTC<br>TTGTATTGATCAATTCATAAGGATGCTTGCAAACAGGGAAATGAAAA<br>ATATGGATGAAACTGGACGTGATTTGTACCCAACGTTTCTTCTTGTT<br>AGAGCTTTTCCAAGAAAATTTGTAATCCCCCTGAATAATGGAGTTA<br>CTATTGATCAGTGGATATTGCTTACTATGTTGTTCAAAAAAAAA |
| 46 | GATCAGGGGCGGGGCCGGTGGGGACAACGAGAAAGATTCTCTCTCGG<br>TCGCCGCCGTCGCCGTCGTGTCGCCGTCGTCGCCAGTCACTTCGCAC<br>TGTGTCTGCCGGTCTCCGCTGGAGCTCCTCTGTACCGCTTTAGCGA<br>GTCTACTCCAGCAAGTCAAGCAGACTACCTAAGCAACCCGCTCCTCT<br>CTCTCTCTCTCTCTCTTTCTTTCTCTCTATCTCATCGATCGAG<br>TTCACTCCCGAACGGAGAGAGGCGGAGCGGAGGAAGGAGGAGAGAAA<br>ATGGCGGAAGCGAAGACCGTGCACTCGCCGCTCGTCACCTACTTCTC<br>CATGCTGTCGCTCCTCACCCTCTGCCCTCCTTTCGTCATCTTGCTAT |

TABLE 2-continued

Cell Signaling Gene Sequences

| SEQ ID NO | Sequence |
|---|---|
| | GGTACACGATGGTGCATGCTGATGGGTCTATCGTCCAAACTTTTGAT
TACCTGAGGCAGCATGGACTGCAAGGATTCCTAGACATATGGCCCAG
GCCGACTGCCGTCGCTTGGAAGATCATCGCCGTTTATGCTGCATTTG
AGGCGGCGCTGCAGCTCCTTCTTCCAGGAAAGACAGTCAAGGGCCCT
ATATCTCCTGCTGGGAATCAGCCAGTGTATAAGGCAAACGGAATGGC
AGCATATTTTGTGACCTTGATCACCTATCTTGGCCTTTGGTGGTTTG
GGATTTTTAACCCCACGGTTGTTTATGATCACTTGGGCGAAATATAC
TCCGCACTCATTGTTGGAAGCTTCATCTTTTGTATTTTCTTGTACAT
TAAAGGTCATGTGGCACCATCATCTACCGACTCTGGTTCTTCGGGGA
ATATAATAATCGACTTCTATTGGGGTATGGAGCTCTATCCTCGGATT
GGCAAGGACTTTGATATTAAAGTCTTCACAAATTGCAGGTTCGGAAT
GATGTCTTGGGCAGTTCTTGCTCTAACCTATTGCATAAAGCAGTACG
AACAGAATGGAAAAGTTGCTGATTCAATGCTCGTGAATACAATATTG
ATGTTAGTGTATGTCACCAAGTTCTTTTGGTGGGAAGCCGGCTATTG
GAACACAATGGATATTGCACACGATCGAGCTGGCTTCTACATCTGTT
GGGGATGCTTGGTATGGGTCCCATCCATCTATACCTCTCCTGGCATG
TATCTCGTCAATCATCCTGTTAACCTGGGAACTCAGCTCGCACTATA
TATTTTGGTAGCAGGCATTCTGTGCATATATATCAATTATGATTGCG
ACAGACAGAGGCAAGAATTTCGCAGAACAAATGGCAAGTGCTCAGTA
TGGGGGAAGGCTCCATCAAAGATATCGGCTTCGTACACTACAACATC
TGGAGAGAACAAAACTAGCCTCCTCTTGACTTCAGGATGGTGGGGCT
TATCACGTCATTTTCATTATGTGCCCGAGATTCTTGGAGCCTTTTTC
TGGACTGTCCCTGCACTATTTAATCATTTTCTGCCTTACTTTTATGT
GATCTTTCTCACAATCCTATTGTTTGACCGGGCAAAAAGGGACGACG
ATCGGTGTCGATCAAAGTATGGGAAGTACTGGAAGCTATATTGTGAG
AAGGTTCGATACCGAATTATTCCTGGTATTTACTGAGGTTCAGCAAG
AACTCCTGTATGGGGAAGATATGGTCGGGCGAAAGGAGTCCACATGG
ATCGGCTTTGGCTCGTTCTCATGTACTTCAGAAGATGTCCCTGTACT
TGGTTTTATAGGAGATGCCAGCGGTAGAGCTACTTTTCGTGTTTCAT
GCATGCAGCAGCATTTAACATTGCGTTTATCTTTGCTACTCCAATTC
GGAATGACTTTGTATCGAACTCAGAGTATCGGCACTCAGTAACTGTA
GCTTTAGTTTGAACCGGCTGCCCTGAACGTTGAGGTTTTTCAGACTG
CAGTCTATTTCTGCTTGTATGTTGACTTGACGTAGAAATTGCGTGGT
GGGACTTATTTCGAACGGTGTGTGATTTAA |
| 47 | GCTCTCTCTCTCTCTCTCTACTCTTTCTCTCTCTAACTCTCCGTCCG
CCATTGAAGCTTCTCCTCCAGCGCGGAACCCTAGAGGCATGAAGGCG
ATGAGGAGCACGAAGCCGCTGAAGCCCCTCAAGCTCGCGGTCCCCGC
TCCCGACGCCCCGATCGCCTCCTTCTTGACTGCGAGTGGCACGTTCC
ATGATGGGGATTTGCTATTGAACCACAAAGGTCTGCGGCTCAAGTCT
GAAGAAAAGGAGTCTTGTCTTTCCAATGGTAAGGAACTTGATCTTGA
CTTCTCATTGGAAGACCTTGAGACTATCAAAGTCATAGGAAAGGGAA
GTGGTGGTGTGGTACAACTTGTTCGCCATAAATGGGTTGGAAAACTA
TTTGCTCTAAAGGTCATCCAGATGAATATACAAGAAGAGATCCGTAA
ACAGATTGTACAAGAGCTAAAGATAAATCAAGCTTCTCAATGTCCAC
ATGTCGTGATTTGCTACCACTCGTTCTACCACAATGGAGCTTTCTCC
TTGGTGTTAGAGTACATGGACCGTGGATCCCTGGCTGATGTGATCAG
ACAAGTTAAGACTATTCTAGAACCATATTTAGCAGTGGTCTGTAAGC
AGGTCTTACAAGGTCTTGTTTATTTGCACAATGAGAGACATGTAATA
CACAGGGATATAAAACCATCCAATCTGCTTGTGAACCACAGAGGTGA
AGTCAAGATTACAGATTTTGGTGTCAGTGCTATGCTAGCGAGCTCAA
TGGGTCAACGAGATACATTTGTTGGAACTTACAATTATATGTCGCCT
GAGAGGATTAGCGGGAGCACATATGACTATAGCAGTGATATCTGGAG
TTTGGGCATGGTAGTACTTGAATGTGCTATAGGACGCTTTCCTTACA
TGCAATCTGAAGATCAGCAAAGCTGGCCAAGCTTTTATGAGCTTTTG
GAGGCGATCGTCGAAAGTCCACCACCTTCTGCTCCAGCAGATCAGTT
TTCCCCAGAGTTCTGCTCATTTGTATCTTCCTGCATACAAAAGGACC
CTCAACAAAGATCTTCGTCTTTGGACCTTTTGAGTCATGCTTTCATA
AAAAAGTTTGAAGACAAAGATATCGATCTTGGGATTCTCGTAGGTAG
CTTGGAACCTCCCGTAAGTTTTCCGAGATGCTAAGCTGTGGGTGCTT
ATGGGGTAAAATCCTCTTACTCATATGTATCCTTCCTGCGCGTGGTT
GAGGATTCGCATAGAGTGACTTCGCTTGAGCAATTGAGCAAATGATG
ATAGAAGTCTCTTACTTATAGAAAGAGCAGCATGCCAAGGTTCTGTA
CTGAGAAAATTCTGCCTTCTACTTAATCCTACCAGCTTAAGTGAGCT
TACCCGAGATGTACTTGTTTTGGCTCCATAACCTTAAAGAGCTGACT
CCTGAAAACAAGAAAACAAGAAGACAGGCATCTATAATCCATGCTT
AGCCTTTATAATCCATCTTCTTAAACATTTTCTGCTCATGTATGCGA
GAAGAAAGGCAGATGCATCAAGCCTTTTCTGATGCTGCCCTTGAACA
ATTCCCAAAAAAAAAAA |
| 48 | GAAGAAGGGGCCGGGCTCGAGCCCAGAGAGAGAGAGAGAGAGAGGGC
CCACGGAGGGCCCACGGAGACGCTCCCGCGCGAGGAGGGCTTTCTGT
CGCGCTGCAGGAGGAAACGGACAGCGACGCTGCTTCGCTCCCAATCT |

TABLE 2-continued

Cell Signaling Gene Sequences

| SEQ ID NO | Sequence |
|---|---|
|  | TTCAATTTGTTTGAACTTTTGAGTTGAAAGGGCCGAAAGGCGAATCT<br>CAATGGCTTGGCTTCCATCACTTCCCTGATTTCTTCCCTCCATTTCC<br>ACCCCCACTCTCCCTCCACCCACCATTCCGAGCGCACCAGCCGCGTC<br>CGACCAATCTTGGGTTGCTCTCGTTTCTACCCAACAAGGTTTCCTTG<br>GGATGGATTCAACCACACAGTTTCCAGCGTCGGCCACTCTCGATA<br>AAACTCTGGCCGCCTAGTCAAAGTACTAGGATTATGCTTGTGGAGCG<br>TATGACAAAAATCTAATAGCTCCATCTGTATTGTCTAGAAAGTATGG<br>CCTTCTGAGTAAGGAAGAGGCCGAGGAGGATGCCAAGCGCATTGAAG<br>AGAGCGCATTTGCTATCGCCAATCAACACATGGAGAAGGAGCCAGAT<br>GGTGATGGGAGTTCTGCAGTACAAGTTTATGCTACACAGTCAAGTAA<br>ACTTATGCTGGAAGTCATCAAAAGAGGCCCAAGGATGAAGGTGGATG<br>GCGAGGCCATTTTACCTGCAAAAGCTATTGCTGCAAGTGAAACTGTC<br>TTTGACATCTCTGGAGGTCGACGGGCCTTTATTGATGCGGAAGAAGC<br>TGAGGAGCTTCTTAAACCATTGAAGGCACCAGGGAACTTCTACAAGA<br>AAATATGTTTCAGCAACAGAAGCTTTGGCTTAGATGCTGCCCGAGTT<br>GCTGAACCTTTTCTAGTATCTGTCAAGGATAAATTGACAGATGTTGA<br>TCTGTCAGATTTTGTTGCAGGAAGACCGGAAGCCGAAGCTCTTGAAG<br>TGATGAATATTTTTTCTTCAGCCCTTGAAGGTTGCAACTTGAGGAGT<br>CTGGACCTATCCAACAATGCATTGGGAGAAAAGGGTGTCAGGGCATT<br>TGGAGCACTTCTAAAGTCTCAAATAATCTCGAGGAACTTTATTTGA<br>TGAATGATGGTATCTCTGAGGAAGCTGCTCTGGCAGTTTGTGAGTTA<br>CTTCCTTCTACTGAGAAGCTTAGGATCCTTCACTTCCATAATAACAT<br>GACTGGAGATGAGGGAGCGCTTGCCATTTCTGAGATTGTGAAGCATT<br>CTCCGGTGTTGGAGGACTTTCGATGTTCTTCTACGAGGGTAGGCTCA<br>GATGGTGGAGTTTCTCTGTGGATGCACTTAGCGCATGTTCCCGGATC<br>AAGAAGCTTGATCTGCGGGATAACATGTTTGGTGTCGAATCTGGAGT<br>TGCTTTGAGCAAGGCTATCCCTTCATTTGCTGACCTAACAGAGGTGT<br>ATTTTAGTTATCTAAACTTGGAGGATGAGGGCACAGAAGCTCTTGCC<br>ATTGCTCTCAAGGAATCTGCACCTTCCCTTGAAGTTTTGGAATGGCA<br>GGGAATGACATTACTGCAAAAGCTGGTGCTGTTTTAGCAGCCTGTAT<br>TGCAGCAAAGCAGTTTTTGACCAAGTTAAATCTGTCTGAGAATGAAT<br>TGAAGGATGAAGGTGCAATATTGATCGGTAAGGCTTTGGAAGAGGGC<br>CATGGACAGTTGGTTGAAGTTGATTTGAGCACAAACTCGATTAGAAG<br>GGTTGGAGCAAGAGTCCTAGCCCAGGCTGTTGTGCAGAAACCTGGAT<br>TTAAAATGCTGAATATAAATGCTAATTTCATTTCGGAGGAAGGGCTT<br>GATGAGGTAAAGGATATATTCAAAACTTCTCCTAATATGCTTGGTCC<br>ACTTGATGAGAATGACCCTGAGGGTGAAGATTTTGATGAGGAGGCTG<br>ATGAGGAAGGCGCTGGTCACGAGGATGAATTGGAAGCCAAGCTCAAG<br>GATCTTGAAATAAAGCATGAGGAGTAGTTTGGTTGATTCTCTGATTG<br>TTTGATTGAGAGAGTTTTTAGTAATTTTAAAACTGGTTCAGCTCTAT<br>TTGCAATGTCTAGTTGCTTAATTTTAGGTTAGTTAGGTGATGTTCTT<br>GTCAAATCTGTCATTGCATGTGAAGTTCAGAAACATGTAAGATGATG<br>ATTTTTCTTGCTGGCAAGTTTAGCAGATCATCATAGCAAAGCTCCAT<br>CTGAAGGGTATTTGATAAGGTTACTTGGGAAAAAAAAAA |
| 49 | CTCTCCTGGTTCAAAAACCTAGAGAGAGAAAGAAGAGAGAGAGAGAG<br>AGAGACGGAGACCGCAGGAAATTCATCGACGAGAGCCGCTCGTCTCC<br>GATCCGCCGCCGCGCGATCGCCGATCGATCCGGCCGGAGCCGTGCGG<br>AGATCGGTAGGGTAGATTGCCGAATCGGGGCTGGACCTCGCGACCCG<br>CGATCGGGATTCGGCACGGAGGTCCTGCGCGCGATCGGATCTGGTGG<br>GATCGATTTCGAAGGGCGTAGAAGGAGAAGAAGCAGGAGGAGGAGGA<br>GGAGGAGGAGAAGGAGGAGAATGGTGAAGCTCACGATGATCGCCCGC<br>GTCACCGACGGCCTCCCGCTCGCGGAGGGGCTCGACGACGGCCGCGA<br>CGTGAAGGACGCCGAGTTCTACAAGCAGCAAGTCAAGGCGCTGTTCA<br>AGAACCTCTCCAAGGGCCAGAACGAGCCCTCCAGAATGTCGGTCGAA<br>ACCGGCCCTTACTACTTCCACTACATCATTGAAGGGCGCGTCTGTTA<br>CTTGACCATGTGCGATCGATCTTACCCCAAGAAGCTCGCGTTCCAGT<br>ACCTGGAGGACCTCAAGAATGAATTCGGGCGCGTGAATGGGGCGCAG<br>ATCGAAACCGCGGCTCGGCCGTACGCCTTCATCAAATTCGATACGTT<br>TATACAGAAAACAAAGAAACTTTATCAGGACACTCGTACCCAGAGGA<br>ACATTTCGAAGTTGAATGATGAACTCTATGAGGTCCACCAGATTATG<br>ACCCGCAATGTCCAAGAGGTACTTGGCGTTGGCGAAAAATTGGACCA<br>GGTCAGTGAAATGTCTAGTCGGTTAACATCAGAATCTCGCATATATG<br>CCGACAAGGCCAGAGACTTGAATCGACAGGCACTAATTCGAAAATGG<br>GCCCCAGTTGCCATTGTTCTGGGAGTGGTCTTCCTTCTCTTCTGGGT<br>CAAATCAAAGATATGGTGATGTGACTGCCTTGCCTGTACTTCTGTTC<br>TACTGCAGTGGGCTGCTGGGTTGCTGAGAGATTCATTCTCAACGATT<br>TTAAATGGGGCACGGGATTTTCACAGAGAATCATATGCGTTCAAAAG<br>TTAGTGTAGTTCTTCTAATTGCATTTTGTATTGGATGCTTCATTCCT<br>TATGCAGTTGTGGCAATAGATTTGCCATGTTAAGTAGTGAATAGAGA<br>ACCCTCCCTTAAGCAGGAGCAACATCAATATCTTATTGTCGACAAA<br>CTAGCAGAGTGTTTTCCGTACAGGAGGCTGCGTATAACTTTTGTTCA<br>TCAATACCTATAATCATCTCTTATAGTAAAAAAAAAA |

TABLE 2-continued

Cell Signaling Gene Sequences

SEQ
ID
NO  Sequence

50  CGCTCCTCTCTACAACAATCTCGTGCTCTTTTCCGGCAAACTCCTCC
    TTCGTCTTTGTCCATCTTTCTTGCTATATTATAAGTTACCAAGTCAA
    AAACCCGACAAGCCTTTTTTCTTTGAAGACGATGAGTTACGTTTCAA
    GCAACAGAAAGCCACTGTTGTCTCGGAAAGCAACCAACGACGGTCAT
    GCCGAGAAGTCTCCCTATTTCGATGGGTGGAAGGCCTACGACAAGGA
    CCCATTTCATCCTACGCAGAATCCCAGTGGTGTCATCCAAATGGGTC
    TTGCAGAACATCAGCTCTGTTTCGACTTGGTTCAAGAATGGCTCGTC
    AGCAACCCAGAAGCCTCCATCTGCACTAAGAAAGGAGTGGACAAATT
    CAGGGACATTGCCCTCTTTCAGGATTATCATGGCTTGCCCGCGTTCA
    GAAACGCTGTGGCGAAGTTCATGGGAGAGTGAGGGGGGACAAGGTC
    AAGTTTGATCCCGACCGGATTGTCATGAGCGGGGGAGCCACAGGAGC
    TCACGAGATGATCACATTCTGCCTGGCTGATCCTGGCGATGCGTTCT
    TGGTGCCAACCCCTTACTATGCAGGATTTGATCGAGATTTGTGTTGG
    AGGACTGAAGCACGACTTCTCCCGGTAGTCTGTCACAGCTCTAACAA
    TTTCAAGGTCACCAGGAAGGCTTTGGAAGAAGCATACGCAAAAGCTG
    TTGAGGCCAACATCAGCGTAAAAGGGTTGCTCTTAACCAATCCATCA
    AACCCACTAGGGACCATCTTAGACCGAGACACGTTGAGAGAAGCCAT
    GAGCTTCATCAACGAGAAGAACATCCACCTCATTTGCGATGAGATAT
    ATGCTGCTACAGTCTTTCGTCAGCCTGATTTCATAAGCATCGCAGAG
    ATAATCGAGGAAGATCAAGAATACAATCGCAACCTCGTGCATATAAT
    TTATAGCCTCTCAAAAGATATGGGTTTCCCTGGCTTCAGGGTTGGGA
    TTGTGTATTCATACAATGATGCCGTGGTGGAGTGCGGCCGGAGGATG
    TCCAGCTTCGGTCTAGTATCCTCCCAAACTCAGTACCTAATTGCATC
    CATGTTATCGGACGATCAGTTCATTGGGAAATTCCTGTTGGAGAGTG
    CGGAGAGGTTAGAGACGAGGCATAAGAATTTCACTGACGGACTTCAT
    CAAGTAGGCATCAAGTGCTTGAACGGCAATGCGGGTCTCTTCTTATG
    GATGGATTTGAGGGAGCTCCTGATGGAGAGCACCGTAGAGGCAGAGA
    CGGCTCTGTGGCGGGGCATAATTAACGAATTCAAGCTCAATGTCTCA
    CCGGGTTCTTCCTTTCACTGCTCAGAGCCAGGATGGTTCAGAGTTTG
    CATTGCCAACATGAATGAGGAGACCATGAAGGTCGCTTTAGCACGAA
    TCCGAGAGTTTGTGCGGAGGAATGGCGATAAGCTGAACAGGAAGGAG
    AAGTGCCGGCAGAGCGACCTAAGGCTCAGACTCTCGTTCCGAAGAAT
    GGATGATGTGTTGAGGTCGCCCTGCATTATGTCCCCTCACTCGCCCA
    TCCCTCAATCACCACTGGTTCGAACCAGAACTTGAAGTTGGCAATCG
    CGTGATTCTACAAACGGGCATTTTTCCCATTAAATCCAAAGCTTTCC
    AAATGTAAAATAGGGAATTGTATTCTTTATTTGCTTGTAACTGGGTG
    CAGTGCAGAATGCATCCTAATTTTTCTGCACCCCATTTTGTTCATTC
    TTTCATCAGGCACGGTATTTTAATTTTTTCCTTCTGTATAATCCCTA
    AGATGGCCCTAAGTTCCATCAGGATTGACATTTTCAACAATATTCAG
    ACTGTCGTGTTGTTTTCAAAAAAAAAA

51  CTTTAAGTTCATCGTATCCCCTTGTCCTTTTGTTCATGGATTCCGGA
    AACTCACGAAGAGAAAATTTGCAGGAATCCTTTACCTAATTATCTT
    GCGGTGCATGCGTAGGTATCCACCAGTTTCATCACCACGCACTTTCA
    GTTCTCCCGATCCCCTTTTTAAACCCCCTCTCTCTGCTCACGCCCT
    TCTTTCAAGATCTGATCAAGATTTTTATCTATAGATTCTTCTTTATT
    TCAAGATAAGCGATTCGTTTGGTGTGTCTTGCAAGATCTGAATGGAC
    CTTGGAGCTTGCAAGAACCTCTCCTCGTCGAGCCGGTTATGGGCTT
    GATCCTTGGTGGGTTTTGGCGGAGGAATTCAAGAAAGTCGGCGGTTC
    TTTCTTGAGTGGTGAAACAGGGGAATTCCTTCCTCCTGTTGTTGCCC
    TCTGAACGTTCTTGCGTCTCTCTACTTTCTGGGAAAATAGCGAGTGG
    GAGAGCTGAAATCATGTGAGGGGAGAGAAAAGGAAAAAAAGGTTTTG
    AAGAATCTGGCGCTTGGCTGTTTCGTGTTTCGTGGTGGGTCTGTTCT
    GGAAGAGGAGCCCGGAGAAGGTAAAGGATAGAATTTTATACTCATCA
    AGAAAGGAGATCAGAGGAAAACCGAAAAGGGGCAGAGAGCATAAGCA
    CAGTTCCTCACAGCAGGAGCGGCAAGGGAATCCATGGCGACTCTGGT
    CGAGCCCCCGGATGGAGTTAGGCAGAGAGGGAAGCAGTACTACTCAA
    TGTGGCGGACCCTGTTCGAGGTGGACGCCAAGTACGTCCCCATCAAG
    CCCATCGGGCGAGGGGCGTACGGCGTGGTGCTCGTCAATCAACCG
    GGAGACACACGAGAAGGTCGCCATCAAGAAGATCCACAACGTGTTCG
    AAAACCGGATCGACGCCCTCCGGACCCTGAGGGAGCTCAAGCTCCTG
    CGGCACATCAAGCACGAGAATGTGATCGCCCTCAAGGACGTCATGCT
    CCCGGTCCACAGCGCTAGCTTCAGGGAGGTGTACCTGGTTTACGAGC
    TCATGGACACCGACCTGCACCAGCTCATCAAGTCCCGCAGCGCTG
    TCCAACGAGCATTGCAGGTTCTTCATTTTTCAGTTGCTGAAAGGGCT
    GAAGTATCTGCACTCAGCCAACGTTCTTCACCGCGACCTCAAGCCCG
    GAAACCTCCTGGTGAACGCCAACTGTGACCTGAAGATATGCGACTTC
    GGACTCGCGCGGACCAACCAAGGCGACGGGCAGTTCATGACTGAGTA
    CGTGGTCACGCGCTGGTACCGTGCCCCTGAGCTGCTGCTCTCATGCG
    ACAACTATGGGACCTCAATCGACGTCTGGTCCGTGGGCTGCATCTTC
    GCCGAGATCCTCGGGCGCAAGCCCTTGTTCCCCGGGACAGAGTGCCT
    CAACCAGCTGAGGCTGATCATCGACACGCTGGGAAGCCAGGGGGAGG

TABLE 2-continued

Cell Signaling Gene Sequences

| SEQ ID NO | Sequence |
|---|---|
|  | AGGACATCGAGTTCATCGACAACCGGAAGGCCCGGAGGTACATCAAG<br>GCGCTGCCCTTCTCGAGGGGCACCCACTTCTCCCAGCTGTACCCGCA<br>GGCCGATCCCCTGGCGGTGGACCTGCTGCAGCGGATGCTCGTGTTCG<br>ACCCGAGGAAGAGGATCACAGTGACGGAGGCCCTCCAACATCCGTAC<br>ATGGCAGGCCTGTACGACCCGCGGGGCAACCCGCCGGCTCAGTACCC<br>GATCAACCTCGACATTGACGATAGCATGGAGCAGCACATGATTAGGG<br>AGATGATGTGGAACGAAATCCTTCACTACCATCCTCATCAGTATGCT<br>TCCCTCCATGGATAAAATAGCGGAATCCTTCACCATCGACATGCCAG<br>AGCAAGAATTTTCTATCCTCTGTTCCCTGAATTTTCCCCTGAAACTT<br>TCTTGTTGGTTCCTGCATTGAGAGAGACCTAATTGCTTGATGTCCTG<br>TAATTTGTAAAAAGTTGCAATGGCCACACCAACTAAGATAGCACATT<br>GCAATTTCTTTAAAAAAAAAA |
| 52 | CTCGTTGCTTCGCGGTCGAGGGAGGGCGGGGGGGGGATCGACCGGAT<br>GGGGCAGCAATCGCTGATCTACAGCTTCGTGGCCCGGGGCCCCGTCC<br>TGCTGGCCGAGTACACCGAGTTCAGCGGCAACTTCACCAGCGTCGCC<br>TCCCAGTGCCTCCAGAAGCTCCCTGCCACCAGCAACAAGTTCACCTA<br>CAACTGCGACGGCCACACCTTCAACTACCTCGTCGACGATGGCCTCA<br>CTTACTGTGTGGTTGCAGTTGAGTCTGTTGGGCGCCAGATTCCAATG<br>GCTTTCCTTGAGCGGATCAAGGAGGACTTTACTCACAGATACGACGC<br>AGGAAAAGCTGCAACAGCATCTGCTAATAGCTTGAACAGGGAGTTTG<br>GGCCTAAACTCAAGGAGCACATGCAATATTGTGTTGATCATCCGGAA<br>GAGATCAGCAAACTTGCTAAGGTGAAAGCTCAGGTATCAGAAGTGAA<br>GGGAGTAATGATGGAAAATATTGAGAAGGTTCTTGATCGTGGTGAAA<br>AAATCGAACTTCTGGTTGATAAGACAGACAATCTTCGTTCTCAGGCT<br>CAAGACTTCAGGCAGCAGGGAACCAAAATGCGAAGAAAATGTGGCT<br>GCAGAACATGAAAATAAAGCTGATAGTTCTGGGCATTATTATTGCTT<br>TGATTCTGGTCATTGTTTTATCTGTTTGTCATGGCTTCAATTGTGGT<br>CATAAATAGTGGAGTGGTGCTGCTAATAGGTTCTTATGAACCTGTCT<br>TGAAGGTATTTTGCCTGTAAGTTTTCTTTCCTCTTTTGTTCTTTACA<br>TGGTCCTTCATTATACTATAGCCTATAGAAGAAATACATTTGCATGT<br>ATAGTTTGTATTCTTGGACAAGTTCTATAATCATCGCGCCCCGGATT<br>GTAATGTCAGCGACCTATGAGTGCTGATAAAAAAAAAA |
| 53 | AGCTATTATCCTTTGCTTCCAAGTGCTTCTCCGTCGTACTTGGCGTG<br>TATAAGTCGAATCTCGCCTGAATTTGCTGATGTTTCTCTAGATCCTT<br>AGATTAAGGTTTGATCTGTGTATATGCTGTGTCGTTGCCTGAGAATG<br>GTTCTGGGTTTGATGATGGCGATATTGGTCGAGGCGGCTGTGCTGTG<br>AGATTCTTTGTCGAGATCGCCGGTTGAGCTTTTCGGGAGTTTGTGTA<br>TTGTTTGGAGGTAGTTTTGCGAGAAATGTAGGACATTGATGTCGTCG<br>TTGAGTTTAATAACTTAGTTCTGTTCAGTTTCTTGGTTTTCCGTGGC<br>AGAACGGCGAGTGTGGAAATGGCTGATGTAGCGGGTCGTCGTTGAGT<br>TTATTAACTTAGTTCTGTTCAGTTTCTTGGTTTTCCGTGGCAGAACG<br>GCGAGTGTGGAAATGGCTGATGTAGCGGGTCTGACTGAAGCGGCGGG<br>GTCCAGATTCAGTTCGCTCGAGTTGATTGGGAGAGGATCTTTTGGAG<br>ATGTCTATAAAGCATTTGATAAGGAGCTCAACAAAGAAGTTGCTATC<br>AAAGTTATTGATCTGGAGGAGTCAGAGGATGAAATTGAAGACATTCA<br>GAAGGAAATTTCTGTTCTATCACAATGTCGATCTCCATATATTACGG<br>AATATTATGGTTCCTATCTCCACCAGACCAAGCTATGGATAATAATG<br>GAGTACATGGCCGGTGCTCCGTTGCTGATCTACTTCAATCAGGTCC<br>ACCTCTTGATGAGATGTCCATAGCCTGTATTTTACGTGACTTGCTGC<br>ATGCAATCGAATATTTGCACACTGAAGGGAAAATTCACAGGGATATT<br>AAAGCGGCCAACATTTTATTGAGCGAGAACGGTGATGTTAAGGTTGC<br>AGATTTTGGTGTTTCTGCTCAATTAACTAGAACTATATCAAGGAGAA<br>AGACATTTGTCGGAACCCCATTCTGGATGGCTCCGGAGGTAATTCAG<br>AATTCGGATGGGTACAACGAGAAGGCAGATATCTGGTCTCTAGGGAT<br>CACTGCGATTGAGATGGCAAAAGGTGAACCTCCGCTTGCAGATCTTC<br>ACCCAATGAGAGTTCTTTTTATCATACCTCGAGAAAATCCCCCACAG<br>CTGGATGAGCATTTTTCTCGTTCCATTAAAGAATTTGTTTCCCTGTG<br>CCTGAAGAAAGTACCGGCAGAGCGGCCCAGTGCCAAGGAACTTCTGA<br>AGCACCGTTTCATAAGAAATGCCAGGAAGAGTCCAAGGCTTCTAGAG<br>CGAATAAGAGAGCGTCAAAATATCCGACAGTGGAAGATGGAGAAAC<br>ACCTATGATTGGTAAAGGTGTAGTGGAGGGATCAGACACTGTGAAGA<br>TTAGAAGAGACATAAAAGGAGAAGAAACAGTAAGAGCCAGTAATCAA<br>GGGCGAGGAGGGAAGAATACTGGATGGGATTTCAGCATTGGTGGAGT<br>GCAGGGAACAGGGACTGTTAGGACCAATCTATTGCCACCTCAAGTCA<br>GAGAGAGGAAATCAGAGAATTCCCACAATCAGGCTACCCCTAGAAGA<br>GTGGCGATGGTGGTAACTCATGGTTGTCTGCATCTGGAAATTCACC<br>TCAGGCTGCAGAAATATCACTTCGGAAAGATGCTAGAGATTTGCATT<br>ATAATAATCACCACGATGACGAAGATTCATCTTTGAGCGGATCGGGT<br>ACGGTCGTGGTACGAACTCCTAGAGAATCTCAACCATCACCCTTGCT<br>TCGCGATCAAAGCACTCTGTCTAGCAGCTCGTACAGTTCTGTTGAAG<br>ATGCTTCTACAACAGGAACTGTAGTTTTCCGCGGTCAACATGATGAG |

TABLE 2-continued

Cell Signaling Gene Sequences

| SEQ ID NO | Sequence |
|---|---|
| | TCTGATTCTCCTCGGACACCAAAATCGAGACTCGGGATTCAGGAGAG<br>AAGTTCCAGTGCTTCACTGGAAGACAGTGCAGCAAACCTTGCAGAGG<br>CTAAGGCGGCTATGCAAGGCGCTTTTAAAAGAGGAAATGCAAGAGAA<br>AAGAGATCTGTACTAGGTAAGTTTAATGACGGGCAGGAAAATGGGAA<br>TAGAGAACAACTTACAAAAAGCCCTGATTCGTCGAGGAATTCCTATG<br>AGTATTTTGATGCTCATAAAGTTCTCCCGAGGTCCCGCCAAGCAAGC<br>GATGATGAGGACATTGCAAAAATTTTATCTTCATCTGCTCCATTATC<br>GGTTCTGCTCATCCCTTCCTTGAAAGAGACAACTGGTGATGATTCTG<br>ATGGGCCAGTTGTCCATGCTGTTTCAACCTCACTCACTAACTTAGAG<br>CGCATGAAGCCAGGATCATGTGAGGTTCTTATAAGCAAGTTGCTACA<br>GAGATTGGCAAGTTCAAAAGAATCCTCGTTGAAAGACTTGCAGGATC<br>TGGCAACTCACACCTTTTCCAAGGGCAAGATATCCCCAGAAAGTCG<br>GGAAATGCGAACACTGAAGCTGATAATCGCAAGAAACAACAGAACAA<br>AGAATTCAATTCTAATGCTAATTTAAGCCCACTAGCAAGATTTTTGC<br>TCTCAAGATGGCAAGGCCAAGTATCCCGAGATCTTAACCCAACTTGA<br>GAGAGAAGAAGAGAATAGTATCTATTTGTTTGTATTGTGCTTCGTGT<br>CGATGCATTTATTCTGATTCACTGTACATAGAAATGATAGTGTATTT<br>ATTAGCAACCAACCTTTGTCTGAGTAAATTGCCTCTGATGGTAAGAG<br>TTGCTGCGCGACTAGGAGGTTTGTTGGTGCACTAACAATGTAAA<br>AAAAGACAAAATGGACCATCATTCTTATTTATCGATGGTTGAATTTT<br>GGCTTTTATTTTCTCGCCAGAGCTTTCCCGCCGTTTTCGATCAATAC<br>AAAGAAGAGCAGTACCATGGATTTGACAGAGTAAAAAAAAAA |
| 54 | AGAAAATACAGAAATCTCAGCACGATCCCCATCTCCTCCTTCGCCAA<br>AGTCGTTGGGAACTTCCCCCCTTCTCCCTCTCGCTCCGTCCACGAAG<br>CAAGCAAGCTCTCCGCGAAGATCCCTTCCTTGTTGTTACCAAATTGG<br>TTGAAGCTTCTTGTGGGTTGCTGGACCTGCAGATTTTGGTTAATAAA<br>TGAGTCAGAAGGGCCTTATATATAGCTTTGTGGCGAAAGGGACTGTT<br>GTTCTGGCCGAGCACACGCAATTTTCGGGAAACTTTAGTACTATTGC<br>TGTGCAGTGCTTGCAGAAGCTGCCTTCTAATAGCAGCAAGTACACAT<br>ACTCCTGCGATGGGCACACATTTAACTTCCTAACGGATAGTGGATTT<br>GTTTTCCTGGTTGTTGCTGATGAGTCCGTCGGAAGAAGTGTGCCTTT<br>CGTGTTTCTTGAGCGAGTGAAGGATGACTTTATGCAGCATTATAGTG<br>CCAGCATTGCAAGTGGCGACCCACATCCACTTGCAGATGATGATGAG<br>GATGACGATTTGTTTCAAGATCGTTTTAGCATTGCATACAACCTTGA<br>CCGAGAGTTTGGGCCAAGACTTAAGGAGCATATGCAGTACTGCATGA<br>GCCATCCAGAGGAGATGAGTAAGCTATCCAAATTGAAGGCTCAGATA<br>TCAGAGGTCAAAGGGATTATGGTTGATAATATTGAAAAGGTGTTGGA<br>CCGTGGGGAGAGAATTGAACTTCTGGTTGACAAAACAGAGAACCTAC<br>AATTCCAGGCCGACATTTTCCAAAGGCAAGGAAGGCAACTGCGTAGG<br>AAGATGTGGTTTCAGAATCTCCAAATGAAGGTTGTGGTGGCTGGAGC<br>AGTTGTCATAGTAATATTCTTGCTGTGGCTTATAGCAAAGTGGGGAA<br>GTAAATAAAACTTGTTCTCAGGGTCGACGCGGCCAAGGTACAATATG<br>ATTTTGTATCTGGATATGTTTGTTGGTATGTGGAGCTAGCCTACCAC<br>TTAGGATTT |
| 55 | CGGCACTCGCCATCGGAGCAGCTGGTGGGATTGCTCGCGGCTTTCTG<br>CTCATGGAAGGAGAAGAAGAGCAGAAGCCGGCGGCGACGAAGCGGAG<br>GAAACCGAGATCGGGAGCGCCTTCTTCCGCCCCGATCAACAATCTCG<br>ATGACGGGTGCCTCATGCACATCTTCAGCTTCCTTTCTCCTATTCCA<br>GATCGTTATAACACCGCCCTCGTTTGCCACAGATGGTGTTACCTGGC<br>ATGTCACCCTCGGCTGTGGCTACGAGTAGACCGGTCTGTAAAGGATT<br>CATCAGAGCCAGGAGTTTTCCCCAATATTGAGTTGGCTGTCTCTGCT<br>GCAAGACCTGGAGATACTATTCTGATTGCAGCAGGGGGAAGTCATGT<br>TGCCTCTAATATTCAGATAAAGAAACCACTTTGCCTGATTGGTGGAG<br>GTGAACTTCCAGACGAGACAATGCTTCTCTGTTCACGAGGTTCAGAC<br>AGTGCCCTGGAGTTCCTTTCCACCTGCAAACTGTCGAATCTAACTGT<br>GAAAGCGGAGCTTGGATGCTGTCTGCTTCATAGGAGCGGAAGGCTGA<br>TTATCGACGGTTGTATTCTCCAATGCGAGACAGACCCTTTAGACTAC<br>CTCTCGTGCCCAATTGTGAGCACAGCTACAGGCAGCAAGGTCGTTTC<br>CTCTCCTAATGGGTGTCATGGCGATGGTGTTTCGGTCTCTCGGACAC<br>GAATTGAAGGTGGTGCCAAAGCCGTATTGACTAGTGGGGACCTGGCA<br>TTGCAGCGTGTTCGGGTTATATGCGCTCGTACTTCTATGTTCTTCTG<br>GTTCGACGTCGAGTGTCCCTCTTGACTCGATATCTTTGTGCTGTTGT<br>CTGTAGTATATATCAGTACCAGTTAGTTTTACTTTTTAAAGATGTTA<br>ATGAATATTGCTGTGATGGTGTGGATACTGTGGAATTTTCATCGTAT<br>CCTGTCATCCAAATCCTTATTTTCTTTTGAGATAATTAACCAATAAA<br>AAAAAA |
| 56 | CGCCCTCGATCTTGCAAGACCAAAAAAACACAGTGAGTCCTCCGTGC<br>GCACCCGAAGAACCACAGGATAAGATAAGCCGCCTGAATCTTCTCTT<br>CTCCTCCCCCTTCAACCGCCCACCTCCCTCGCCGCCTCCGCCTCCGC<br>CGGCGATGGGCCAGTCGTCGTCCTCGACGGCCCCCGCGCTCGGCGGC |

TABLE 2-continued

Cell Signaling Gene Sequences

| SEQ ID NO | Sequence |
|---|---|
| | CGCGGCGCCGACCCCGACCCCGACCCCGACCCCGACGACGGCCACTC<br>GGCGGCCAAGTCGAAGGCCGTGATCTGGCCGGTGCTCGGGGAGGCCG<br>CCGCCGAGGAGTGCGCCGCCCCCGATCTCTCCCTCTCCATCTCCGAT<br>CTCCCCGACGAGTGCCTGGCCTGCGTCTTCCAGTACCTAGGCTCCGG<br>CGACCGGGCCCGGTGCTCCCTCGTGTGCCGCCGCTGGCTCGCGGTCG<br>AGGGCCAGAGCCGCCAGAGGCTCGCCCTCCACGCCCAGTCGGAGCTG<br>CTGGAAGCGGTCCCGGCGCTGTTCGCGCGGTTCGACTCGGTCTCGAA<br>GCTCGCGCTCAAGTGCGACCGCAAGGCGCTGAGCATCGGCGACGACG<br>CGCTCGTGCTGATCTCGCTCAAGTGCAGGAACCTCACGCGCCTCAAG<br>CTGCGGGGCTGCCGCGCGCTCACGGACACGGGGATCGCGGTCTTCAC<br>GAGCAATTGCCGGGGGCTGAGGAAGCTCTCGTCGGGATCCTGTGCGT<br>TCGGAGCCAAAGGCTTGAACGCCGTGATTGATCACTGCGCCTCCCTC<br>GAAGAGTTATCTGTGAAGCGGCTCCGGAGTCCCACTGAAGGTGCTGC<br>GGCGGAGCCGATTGGGCCTGGTGCGGCTGCCGCCTCCCTCAAAACGA<br>TTTGCTTGAAGGAGCTTTACAACGGACAGGGCTTCGGTCCGCTGATC<br>ATCGGCTCGAAGAATTTGAGGACGTTGAAGCTGGTGAAATGTTACGG<br>AGATTGGGACACGGTGCTCCAAGTTATGGTGGAGAGGGTCGCAAAAT<br>TAGTGGAGATCCATCTGGAGAGGATCCAGGTAAGCGATTTTGGCATT<br>GCCTCGCTATCTAATTGCTCGGATCTCGAGATACTGCATCTGTTAAA<br>GACACCGCACTGCACGAACTTAGGGCTCATATCGGTTGCCGAACGTT<br>GTACGTTGTTGAGGAAGCTCCATATTGATGGATTGAAGCTGAACCGC<br>ATTGGCGACGATGGTTTGATTGCTGTCGCAAAGCGTTGCCCTAATTT<br>GCGAGAACTTGTTCTTATCGGCGTCAATCCTACGGAGTTGAGCTTGG<br>ATTTGCTAGGATCTAACTGCCTCACGTTGGAGAGACTGGCGTTTTGC<br>GGTAGCGATACGGTTGGAGACGCTGAGATTATGTGCATCGCGGCTAG<br>GTGTGTGGCGCTCAAGAAGCTTTGCATCAAGAATTGCCCAGTTTCGG<br>ACGAAGGAATGAAGGCATTAGCCTCTGGTTGCCCTAACTTGGTGAAA<br>CTGAAGGTTAAGAAGTGTGGTGGAGTGACTTCTGAGGGTGCAGCTTG<br>GTTAAGAATGAGAAGGGGATCGCTTGCGTTGAATTTGGACTCCAGTG<br>ACCAAGAACAGATAGACGCATTCGCCAGTGATGGTGGAGGAGAAGAA<br>AATCATGTGGAGTTTCCTCCCGTACCTAGCCAAACAGCCGGCGCTAA<br>TATTGCATCATCGAGCGGCACCAGTCGGTCATCTTCCTTTAAATCGA<br>GATTGGGCAGTTTGAGAGGAAAGAGTTTGATGGCATGCACGTTCAGA<br>AGATGGTCAAGTGGCAGTAAAGATTCCTAAAAGCCAAGATCTTAGGG<br>GAATCTCTGAACAGCCAGGGTAAACCAATGACTGTCCCTCGGCGCAT<br>CAAATTTGAATTGTTGACTTTATGGGTCTGAAGGTTTCGAACTTTGA<br>TCTTCAGATGATCAGCTTCGTGCCATCACCGATTGTTGTCCTAACAT<br>GCCCAAACCTGTTTTAATTGGTGTCGGTCCTAAAAAAAATCGTGCTT<br>GAGTTTGCTGGAATTAAATTCCCTGAGTTTAGAGTGGTTTTTAGCAA<br>TCAATGGTTAGGGATACTATTCCCTTCGCTAAATGTACAGCTTTAGA<br>GAAACTTTGTTCGGAGAATTTCCCCATTTCGATTAGGGGTAGAAGCC<br>CTAGTCGGCTGTTGCCCGAACTTGCTGATGGCGATGCTCAGAAGGTA<br>TGTACTGTTTGTGGAGTGACTAGTGAGATGCAGTTTGTGAGGAAAGC<br>TCGTGTTTGAAATTGATGCTTTAAATTGGAGGGAAAAAAAAAA |
| 57 | CGTGAACGTCTTGCGCTCGGTTCTTGAGCTCGTTCTTGAGAGCTGAA<br>CGGAGACGATGGGCGAGGAATCGTTCATATACAGCTTCGTGGCGAGA<br>GGGACGATGATCTTGGCGGAGTACACGGAGTTCACGGGCAACTTCCC<br>GGCCATAGCCGCTCAGTGCCTCCAGAAACTCCCTTCCTCCAACAACA<br>AGTTCACCTACTCCTGCGATCACCACACCTTCAATTTCCTCCTCGAA<br>GATGGCTACGCTTATTGTGTTGTCGCCAAGAATCAGTGGCCAAGCA<br>AATCTCCATTGCATTTTTGGAGCGTGTAAAAGTTGACTTTAAGAAAA<br>GATATGGTGGCGGCAAAGCAGATACAGCTGTTGCCAAAAGTCTGAAT<br>AAGGAGTTCGGGCCAATTATGAAGGAGCACATGAAGTACATTATTGA<br>ACATGCTGAAGAGATCGATAAGCTCATAAAAGTGAAGGCTCAAGTTT<br>CAGAAGTTAAAAGCATAATGCTGGAGAATATTGACAAGGCGATCGAT<br>AGAGGGGAGAACCTGACCATTCTAGCCGACAAAACAGAGAATCTGCG<br>TGATCAGGCTCAAGCATACAAGAAACAAGGGACACAAATCCGGCGAA<br>AGATGTGGTACCAGAACATGAAAATCAAGCTGGTCGTGTTTGGTATC<br>TTATTATTTCTGATCCTTGTAATTTGGCTTTCAATTTGTCATGGATT<br>TGATTGCTCCAACTAGTATATTATCATCACATGGAGAAAGGTTCAGC<br>TTCAATTAGAGAGAAGAGAGAGAGAGATCTTGTAACTATACTGGC<br>GGAGAAATGTATCATTTGTTGTTACTTGGGACTGAAAAAAAAAA |
| 58 | GCATCAAAATTGACATCGCCTCTCCTCTAATGCCTCGGTCGTCTCTC<br>TTCTCTTCCATTTCGCCCTCGTTCTCCACGGCCGTTCCAATCCGACC<br>TCGCCGGAATCTTTGAATTTCCTTTTATTGTTTCCGATCGAGGGGGG<br>TTTCGGCCGGCGGGAGGAGCTGCGAAGATTTCCCTCGCGCGGCGGAT<br>GGCGGGCGGGTACAGGGCCGACGACGATTACGATTACCTGTTCAAGG<br>TGGTGCTGATCGGGACTCCGGCGTCGGCAAGTCCAATCTGCTGTCC<br>AGATTCACGCGCAACGAGTTCAGCTTGGAGTCCAAGTCCACGATCGG<br>CGTCGAATTCGCCACTCGCAGCATCCGCGTCGATGACAAGGTCGTGA<br>AGGCCCAGATTTGGGACACCGCCGGCCAAGAGAGGTACCGAGCAATC |

TABLE 2-continued

Cell Signaling Gene Sequences

| SEQ ID NO | Sequence |
|---|---|
| | ACTAGTGCATATTACCGAGGTGCTGTTGGCGCATTGCTTGTCTATGA<br>TGTAACTCGTCATGTCACATTCGAGAACGTGGAGAGATGGTTGAAGG<br>AGCTGCGGGATCACACCGACTCTAACATTGTTATAATGCTTGTGGGG<br>AATAAGGCTGATTTGCGACATTTACGTGCTGTTTCTACTGAAGATGC<br>CACGGCATTTGCGGAAAAGGAAAATACCTTCTTTATGGAGACCTCTG<br>CGCTCGAGTCTATGAACGTTGAGAATGCGTTCACTGAAGTGCTCACC<br>CAAATACATCGAGTAGTCAGTAGGAAAGCCCTTGAGGCTGGGAATGA<br>CCCTGGAGCTCTTCCTAAAGGACAAACCATTAACGTTGGATCAAAGG<br>ATGATGTCTCAGAAGTTAAAAAGGTCGGTTGCTGCTCTTCTTGAGGA<br>TTTACCCGTCAAACATTTGAAGGAAATGAAATTTTCTCCAGTAGTCT<br>CATGTGTCCAGATGCTTTAGTTTCTCTACTCTCTTTGGTTTTCAGTT<br>TTCTACTTCATACTTGTTGTACTCTCACTTGTATAATTCTTTCCTTT<br>TCTCTGGCTCTTCCCTTCTTTTTTGTCTTGGGGTTGTGATTGCTCTA<br>AATTATTGGGACAAGCTCGAAAATT |
| 59 | GCATCTCCCACCCAACCCCTACTCTCTCTCTCTCTCTATCTCTAT<br>ATCGTCCTGTCAAGAAGAAGGAAGAAGACGAAGAAGGAAGGTGAACA<br>AGAAGCAAGAAGAAGATGCAGCAGTAGAAAGGTGAGATCTCGATCTC<br>GCACCGATGCTCTCGAATCGAACCTGTTCCTCCCCGATCCCCCCGCA<br>TCGATTCGCCTGAACCACAAAAGAGTTCGCATCCTTTTCCCTCCTTC<br>GAGGCGTAGAGCAGTTAGGGCCTTGAGCATTCATGGCGGAACTCGCG<br>GGCGATCTGCCCGGCGAGCTGGTGACCGAGATCCTGGACCGCCTCCC<br>GGTCGAGTCGCTGCTCCGGTGCCGCTCCGTCTCCAAGCGGTGGCGCG<br>GCATCATCGACAGCCGGGAGTTCGTCCGCTCCCACCTCGCCCGCTCC<br>TTCGAGTCCACCGCCAACCTCACCCTCTTCTTCCGCCACTCCTCCAG<br>CCTCTACTGCATCGACCTCACCTCCCTCCTCCGCCACGGCGGCGTCG<br>CCGAGATGAACTACCCGCTCATGTGCTACAGCGACCAGATCCGCGTC<br>CTCGGCTCCTGCAACGGCCTGCTCTGCATCTCCAACGCCGCCGACGA<br>CGTCGTCGTTTGGAACCCCGCCACGCGGAAGCACAAGTTCCTGCCGT<br>ACTCCGCCGTCGAGGTGCGGCGCTCCTCGGTTTTCTCCGTCTGCGTC<br>TACGGGTTCGGGTACGACGAGAGGCGAGACGATTACGTGCTGCTCAG<br>GCTCGTCCAGCTCGTGACGGAGCCGATCGAGTCGGAAGTTAGTATCT<br>ACAGCTTGAAGGATAACGCTTGGAGGCGGCTCAAGGACATGCCGTAC<br>TCCCTCGTTTATCCCCGCAAGATGGGGGTTTTCGTGTGCGGCCATCT<br>GCACTGGATAATGACTCGGGAGCTGGTGTCGGATTCGGCGAATCTGC<br>TGGTGGCTTTCGATTTTCGAATTGAGGATTTTAAGGTGGTGGACCAG<br>CCTGAAGGTATCGATAATAAGCTTGACATGGATTTGTCCGTCCTGGG<br>AGGGTGTCTCTGCCTTAGCATTAACGGGAACCACATGGGTGTCCATG<br>TGTGGATTATGAAAGAGTATGGATTGAGAGATTCATGGACTAAGTTG<br>TTCTCGATACCGCAATCTGAAGTTGCCAGACCTCTTGGGTTTGTCCG<br>GCCGTTGGCTTACGCCAGCAATGGTCGTCAAGTTTTGGTAAGACAGG<br>ACAGTAAGAATCTCATTTTGTATGATCTAGAGACTAAGGGCATGGAG<br>AGGGTTGATATAAATGGCATGCCAAATTCCTTTGAAGCAGAAATTTG<br>TTTGAGAACCCTTGTTTCGGTCGATGATTATGGAGGATACACCAAGA<br>AGAAGCAGCAAGAAGCGGAAGAGATTGAGAATAGGACCAAGAGGGAT<br>GACTTCCTCTCGGTGGGCTTCAAGCTTGTTCTCTAATCGAGACATAG<br>TTGTGCAAGGGGGTGTCACAAACTACTCAGCGAAGGAAATGCAGTA<br>GGAGAAGTTAAGTTTTTTGCCTCAGTATTTAGATTCATGGCTCAACT<br>TTCGACAATATGGACCAATGTATCATTGGGAAAGGTTTGGCAAAAAA<br>AAAA |
| 60 | CTTCTTCTTCTTCTTCTTTCTCCTCTCTATGGCGGACACCGCAA<br>CTCGAGCGATTCCTCCGAGAATGGAGTTCTCCGACGAGGCTGCGGCC<br>GGCGGAGCTGCGGCGCCGGCGGCTGCGGCGGCGGCGGAGGAGGA<br>GGAGGAGGAAGAGGAGGCGCCGTCGCCGGCGGCGGAGATCAGCGAGG<br>TCGAGAAGAGCAAGATCGGCATCATGCGGGCCGTCGTGGAGCGGGAC<br>GACCCTTCCGCCAAGGATGTCGATGATTTATGATACGGAGGTTTCT<br>GCGAGCTCGGGATCTAGATATAGAGAAGGCTTCCAAGCTATTTCTGA<br>AGTACCTGAGCTGGAGACGGTCTTTCGTCCCCAATGGGGTCATATCG<br>GCATCAGAAGTTCCAAATAACCTTGCTCAGCGGAAGTTGTTTATGCA<br>AGGTCTTGACAAAAAGGGACGGCCTATAATAGTTGTGTACGGGGGTA<br>GACATAATCCTTCCAAAGGAAGTCTCGAGGAGTTCAAGCGTATGATA<br>CTTCTCTGATTCTTCCGGATTTTCTTCTAATCAATATGAATTTATCG<br>CTTCATGCAAGACTTACCATCATCATATTATTGAAAAGAAATTTAGG<br>CAGAAAAATACTGAATTTGGCTAAAGTTGAGTTGTTTTTACTGTGG<br>CGAAGGTTTTGTGGTCTACACTCTTGACAAAATATGTTCCAGGTAAC<br>TCTTCTCCTTATTAAGACTCTGCACATCACGGAAATCTAAAAACATT<br>GCAAACTGAGGATTCTTCCAAAAATGAAATCCTTCAGAAGCATTCTG<br>GTTAAGGTGTCTATCTTGTGAGGCACAAAAATTGCACGTGTCACCTA<br>ATTGCATGATTGGAAAAGAATGGCCATATTAGTTGCAAATGAAGCCC<br>TTGAAGACTATATCTAGAGCCACCCTCCTCAATGGGAAGTATCGGAA<br>AGTTTTTACCTGGTCCCTTATTGGTTTCTCAATTCCCAGTTTCTTAA<br>GAACTGTGATCAACCCAAGTCTTTCTTTTGAATTCGCTATCCAGTGT |

TABLE 2-continued

Cell Signaling Gene Sequences

| SEQ ID NO | Sequence |
|---|---|
| | TGGTCAAATTTTAGCCAATAATTTAAGTTGTTTCTTGGGTGTTGATC<br>TTTCAGAATGCCTGGAGGGCAGGAGAAGTTTATGGGCATAGCAGATC<br>TCGAAGGATGGGGATACAAAAGCAGCGACATTCGTGGATACTTAGCA<br>GCATTGTCAATCTTGCAGGACTGCTATCCGGAGAGGCTGGGCAAGCT<br>CTTTCTTATTCATGTGCCTTACATATTTATGACTGCATGGAAGATGG<br>TTTACCCATTCATCGACCCTAAGACGAAAAAGAAGATTGTTTTTGTC<br>GATAACAAAAAACTGAGAACTACTCTGCTCGGGGACATCGATGAAAG<br>CCAGCTCCCGGATGTATATGGAGGCAGGTTGCCACTAGTTGCCATTC<br>AAGACAGCTAAATTCTGCTCAAATTACAAGAATTTTCTCCTCATTTC<br>TTTTCTGGCCGTGGGTCTATATTGTAGAATATAATGAAGATATAATT<br>TGATAAAATGCGGAACAACAGCCAAATATTTCATGGCTGAACTCTCT<br>TGATAAAAAAAAAA |
| 61 | AGAACAAGACCCCGTCCCTCACTACTACTGCACGCGCGACGCGACGG<br>GAGATATGGCTGCTCGGCTCTTTTCAAGCCTCCTCTCTCGCTCCTCC<br>TCCGCCGCCTCCTCCTCCTCGTCGTCTTCTTCTGCTCGTGCTCTGCT<br>TTCTCGAGCGAGAAAACCGCTACTGGGAAGAGAAATCAAGAGCTACA<br>GCACAGCAGCTGCTATCGAGGAACCGATAAATCCAGGCGTCACTGTG<br>AACCATACTCAGCTTTTCATAAATGGGCAGTATGTGGACTCAGCATC<br>AGGAAAAACTTTTCCGACCTTTGACCCCAGGACCGGAGAAGTGATTG<br>CTCATGTTGCTGAAGGCGAGGCTGAAGATATAAACCGAGCTGTAGCT<br>GCTGCTCGCAAGGCATTCGATGAGGGACCATGGCCTAGAATGACTGC<br>TTATGAAAGGGCAAATGTACTATTTCGCTTTGCCGATTTGCTTGAAA<br>AGCATAATGATGAGATTGCAGCACTCGAGACTTGGGATAATGGGAAG<br>CCATATGAACAGGCTGCCAAAATTGAGCTTCCAATGATCGTCCGTCA<br>AATTCGATATTATGCAGGTTGGGCTGATAAGATTCACGGTCTCACAG<br>TTCCAGCTGACGGGCAGTATCATGTCCAAACCTTGCATGAGCCAATT<br>GGGAGTTGCAGGTCAGATTATTCCGTGGAATTTCCCTCTTCTGATGTA<br>TGCTTGGAAGGTGGGACCTGCCTTAGCCACAGGCAACACCGTTGTAC<br>TGAAGACGGCAGAGCAGACACCACTTTCTGCTTTATATGCAACCAAG<br>CTCTTGCATGAGGCTGGTCTCCCCCCTGGAGTGTTGAATGTGGTTTC<br>TGGTTTTGGTCCAACTGCAGGCGCAGCTCTTTCCAGTCATATGGATG<br>TTGATAAGCTTGCTTTCACAGGATCAACCGACACAGGGAAAATCGTA<br>CTTGAGTTGGCAGCAAAAAGCAATCTTAAGCCAGTGACTTTGGAGCT<br>TGGAGGGAAATCCCCTTTTATTGTATGTGAGGATGCTGATGTTGACA<br>AGGCTGTTGAGCTAGCCCATTTTGCTCTTTTCTTCAATCAGGGTCAA<br>TGCTGCTGTGCTGGATCTCGTACATATGTACATGAAAGCATATATGA<br>AGAATTTGTAGAAAAGGCAAAGGCACGGGCAACAGTGCGTAGTGTGG<br>GTGATCCGTTCAAAAGTGGCATCGAACAAGGTCCTCAGGTAAGTTAG<br>CCGATTCTCCTGTATGAGGAAATTTGAATGGATAAGATTGATATCTT<br>GCGAATGGAAGTAAACTCCTGCTCTTATGACTCTTTTGTCAAATGTA<br>ATTGACAAATTTGATATTTTTGTCGATTTCACATAAATTTACTGGAT<br>GGAAATTGAAATGCAACTGAAATAAATCCTTGATAAATGGAGCTAGT<br>CGTTTGACTAGTACCTGTATGTAGATCTAATGGAAGCTACAGAGTTC<br>TGAGCGTTCTTTATCTTTACCTCACATCAGATAGACTCGGAGCAGTT<br>TCAGAAGATTTTGAGGTACATAAGATCTGGAGTAGAAGGTGGAGCAA<br>CTCTTGAAACAGGAGGAGAAAGATTTGGAACCAAGGGACACTACATT<br>CAGCCAACTGTATTCTCAAAATGTTAAGGACGATATGTTGATCGCTA<br>AGGACGAGATTTTTGGTCCCGTGCAGACCATTTTGAAATTCAAGTGA<br>GTATAAGACCATCTCCTCAAGCTCATTACTAGAGCGGCTTTCCGGTT<br>AGGATGCATGGTACGATTGTCTGTTGACATGGTGACATCTTTGTCAT<br>GTTTAATTGCAGGGACCTCAAGGAGGTGATTCAAAGGGCAAACAACT<br>CACGCTACGGGCTGGCAGCTGGAGTCTTCACCCAGAACATAGACACG<br>GCGAATACCTTGACCCGCGCTTTAAAAGTTGGAACAGTTTGGGTTAA<br>CTGTTTTGATGTCTTTGATGCGGCTATTCCATTTGGCGGGTACAAAA<br>TGAGTGGCCATGGAAGGGAAAAGGGCGTGTACTCTCTGAGCAATTAC<br>TTGCAGGTCAAAGCTGTGGTCACTTCTTTGAAGAATCCAGCATGGCT<br>CTAAGCTGAAGTTTGCTTTCATCTTTGGATTTTTCGACCCTTGATAT<br>TTTTTAATAATAAGGGAAGTAACAGATACTGGAGTTCAAATTATTAT<br>CGTGACAGTTGTGATGGGAGTTTTGAGGCGGTGACGACGACGATTGT<br>AGGACGCTGGTGAAATTGCTTCTGTAGCAAACAGTGCCGTGAAGAAT<br>TCACTTTTTGAGTGTTCACGATCAAATTGTGCTACTATACATTATTG<br>ATGTTACTTTTGCCATCTTCCAGGCTTG |
| 62 | GCATGAGTTCCTCCTCCTCCTCCGGCGGCGGCGGCGGCGCGAAG<br>CTCCCTCACGACGTCGCCGTCGAGATCCTGAAGCGGTTGCCGGCGAG<br>ATCCCTCCTCCGATTTAGGTGCGTCTGCCGATCGTGGCGTTCCGCCA<br>TCGACGACCCTCGTTTCGTGGCCCTCCACTGGAGCCACTCCGCCCTC<br>CACGCCTCCAGTCGGCATCTCGCGTGTCTAGACTGCGGCGACGACGC<br>CGTCCAGAACCGGTGCTCTCTGTTCCCCAACGCCCCTCTCGCCCTGC<br>CTCCTCCCCGTCGCAAATCGAAATCCCGTTCGTTGCTCCTCCCAAC<br>CGTTACGCCCTCGTCGGTTCGTGTAACGGTTTGATCTGCGTCTCGGA<br>GAGTTCCAGTGACGGCACTGAGCGGGCGCTGTATTTTTGGAATCTAT |

TABLE 2-continued

Cell Signaling Gene Sequences

| SEQ ID NO | Sequence |
|---|---|
| | TCACCAGGAAGCATAAGGCGGTTCGGCTCCCCCGTCCGGAGCGGATG<br>CCACCCTTCTCCGTGGGGGCGCTCATGTAGTTCTGGGGTTTTGTTT<br>CGATGCGAAGTCTAATGACTATCGTGTTGTCAGGATTATCCGATACC<br>TAGGTATTCGCCGTCGACGCTTCCGCAATAAGAAGCCTCGAGTCGAG<br>GTTTATTCGTTCCGTACAGATTCATGGAAGACCTTGGAATGTGAGGT<br>TCCTCTTCTCTGTGACAGTGCGGTCTTCTTGAATGGGAACCTGCACT<br>GGTATTCTTTCAATGGGGAGGGGGATGGATACGGATCCATAGTCTTG<br>TTCAATGTCGCAGATGAGGTGTTTGATGAAATAGCTCTGCCGGAAGG<br>GATCAGTCCCCATTTTGTGTTGTCCGTGACGGTATTGAATGAATCGC<br>TGGCTGTGTTCTTTAGTCATAGGGAGGCTTGTTTCGTTTGGGTTATG<br>AAAGACTACGGCGTGCCAGAGTCTTGGAGTAAGCTGTATACTTTCGA<br>GGTTACGGAACCGGTAACAGGATTTGATGGCTTTACATGGAATGGCG<br>AGCTTCTTATGGAAATAAATTGTGAAGAACGAGTTTCTTGGAATCCG<br>ATCACAGCACAACTCTCAATTCTTCCATTGTCGGCGAGATACAAATT<br>GGTCCCCGTTGTAGAGAGCCTCGTTCCACCTTAGATATGACTCGATT<br>GCTGCTATATCGTCAGGTGCAAGGTGCTGGAGCTCTTCTTTATTAAC<br>AGGAATTCTGGTGATTGGCAATGCAAGTACAGCTGGCTCTAACAAAA<br>ATGGGGGAGTGGCAAAGGACAGCAGAAAGTGATGTTGAAGTTTCTTC<br>GGAATATAGTTTACGTGGAAGGCAAGAAACAATCTGCTTCATGGTTA<br>AGCTACTTCTCCCTTCGAGCATGTTCTTAGATTGATCGATTTGTTAC<br>TTAACATCAATTTGAAGGCTATCTAGTTTCAAAAGGATACATGTCGT<br>GCTTATGATTATCTATATAATGTAATGTGTGAGATTTGCTTATAAAA<br>AAAAAA |
| 63 | CAAGCGCACTGCATTGATTTTCGAACATCGCCGGACGAGACACACAC<br>AATTCGCTCTCATTTTCAAAATCGATCTATCCAAAACCCTCTTTCTG<br>TCTTTAGGCCATTTCTCCTCTTTGCCATCTCACAGTCTCACTCGCCT<br>TTCATTCGACGCTCGTCGCTCTCTTTCCCCGAACGTTTGAAGAAAAC<br>GCGACGGTTTTTGAGGTTGTGTTGTGATGGATGCTGCACCATTGACT<br>TCTCAGCGCCGACCATTTTCAGTGAAACTATGGCCCCCGAGCAAAAA<br>TACTCGTGAAACACTTGTAGAACGGATGACAAGGAATCTCACAAGTG<br>AATCCATTTTCACTAGGAAGTATGGAAGTTTGAGCCCGGAAGAAGCT<br>GAGGAAAATGCAAAAGAATTGAAGATGAAGCTTTTACAACTGCTAA<br>TCAACATTATGAAAAGAGCCTGATGGTGATGGAGGGTCTGCAGTGC<br>AGCTCTATGCTAAGGAATGCAGTAAACTTATACTGGAAGTCCTCAAA<br>AAAGGCCCAAAAGGCAAGGATGAAAAGCCGCCAACTTCTGACAGTGC<br>TAAGGCCCCTAGAGAGACATTTTTTGATATTTCCAAGGGCCAGCGGG<br>CCTTCATTGAAGCAGAGGAGGCAGAAGAACTTCTGAGACCATTGAAG<br>GAGCCTGAAAATTCTTTCACCAAAATATGCTTTAGCAATAGAAGCTT<br>TGGATTAGGAGCTGCTCATGTTGCTGAACCCATTCTGATTTCCCTGA<br>AGCAACAATTGAAGGAGGTAGATTTATCTGATTTCATTGCAGGAAGG<br>CCAGAAACAGAAGCTCTTGAAGTCATGAGCATATTTTCAGCTGCCTT<br>GGAGGGTAGTGTTTTGAATTCTCTAAATCTTTCCAATAATGCTTTGG<br>GTGAAAAAGGCGTCAGAGCATTTAGCGCACTCCTGAAATCACAGAGT<br>CAATTGGAGGAGCTCTATTTAATGAATGATGGAATTTCTGAAGAAGC<br>TGCTCGTGCAGTATGTGAGTTGATCCCTTCCACAGAAAAACTTAGAG<br>TTCTTCATTTTCACAATAACATGACAGGAGATGAAGGGGCGATTGCT<br>ATTGCTGAGGTTGTGAAATGCTCTTCATTAATGGAGGACTTCCGCTG<br>CTCCTCCACAAGGATTGGCTCTGATGGAGGTGTTGCCTTATCAGAAG<br>CACTTGAAAATTGCATCCATCTGAAGAAACTTGATTTGAGGGACAAT<br>ATGTTTGGTGTAGATGCTGGAGTTGCTTTGAGTAAAGCTCTTTCCAA<br>GCACACTAATTTGACTGAGGTTTACTTGAGTTACCTGAATTTGGAAG<br>ATGAGGGGGCAATTGCTATAGCCAATGTTCTTAAAGAGACAGCCTCA<br>TCTCTTACAGTTCTAGATATGGCTGGCAATGACATAACAGCGGAAGC<br>AGCTCCAACTTTATCTGCTTGTATAGCTGCAAAGAATTCTTCTCACCA<br>AATTGAACTTGGCTGAGAATGAGCTCAAGGATGAAGGTGCTATTCAG<br>ATTGGCAAAGCATTGCAAGAAGGCCATGAGCAGTTGACGGAAGTTGA<br>TTTGAACACCAACTCGATCAGAAGGGCTGGAGCTCGATTCTTGGCCC<br>AGGTTGTGGTGCAGAAGCCTGGTTTCAAGTTGCTCAACATCGATGGA<br>AATTTCATTTCGGAAGATGGGATTGATGAGGTCAAGAGTATATTCA<br>GAAATCCCCTGAAATGCTGGCTTCCCTAGATGAGAATGACCCTGAAG<br>GAGGTGATGAAGATGAAGAGGACGAGGAAGGTGAAGCGGAAGGTGAA<br>GCTGATGAAGGTGAGCTGGAGTCAAAGTTGAAGAATCTTGAAGTAGG<br>TGAAGAGTAGGATATGTTCTTTCTAGTTTAAGGTAATTTGAATTGGC<br>TGTCCAAGTTAGTTCAGGAACAGCTTTAATAGCCAGGAACATTTTTG<br>CTGAATTTTTAGCTCATTACATCGTCGAGGCTCATGAACCATGAGCA<br>GGATAATCGTAGCTCCTAGAGATGAGCATTTTTTTACTCAGGAGGA<br>CGACCTTGGAGGAGCTGTTCGTAGGGTACTCATTTTACAGTGTACCG<br>GGTAATCTTGTCGTATGAAGGGATTACCAGAACTTCCGTTCTAGTTA<br>CTAGCTACTAGCTACTAGCTAGTGAATTGTTTTAATGCGCTTCTTC<br>TCTCCTAGCTGATTTTATTCATTAAAAAAAAAA |

TABLE 2-continued

Cell Signaling Gene Sequences

| SEQ ID NO | Sequence |
|---|---|
| 64 | GCTCTCTCTCCCTCCCTCCTTCCCTCTGATGGCACTCGTCCGCAAC<br>GCCGGCAGCTCAACCTCCGCCTCCCGCTGACGGATCTCCCCAACCGC<br>CGCCCGCTCTTCCCGCCGCCCCTCTCCCTCCCCCTCCCTCCCTCCGC<br>CGCCGCCGCCGCCTCCGCCACCGCCGCCGCCGGCTCCGGCGCCGCCG<br>CGACCTCCCTGTCCGACCTCGAGAGCCTCGGCGTCCTCGGCCACGGG<br>AACGGCGGCACCGTCTACAAGGTCCGCCACCGGCGCACCTCCGCCGT<br>CTACGCCCTCAAGGTCGTCCACGCCGGCTGCGACGCCACCGTCCGCC<br>GCCAGGTCCTCCGCGAGATGGAGATCCTCCGCCGCACGGACTCGCCG<br>CACGTGGTCCGGTGCCACGGCATCTTCGAGAAGCCGAACGGCGACAT<br>CGCGATCCTGATGGAGAACATGGACGCCGGCAGCCTCCAGACGCTCC<br>TGGAGGCCTCCGGGACCTTCTCGGAGAAGCAACTCGCCGCCGTCGCC<br>CGCCACGTGCTGAACGGGCTCCACTACCTCCACTCCCTCAAGATCAT<br>CCACCGCGACATCAAGCCGTCGAACCTGCTCGTGAACTCGGCGATGG<br>AGGTCAAGATCGCCGACTTCGGGGTGAGCAAGATCATGTGCCGGACC<br>CTCGACGCGTGCAACTCCTACGTCGGCACGTGCGCGTACATGAGCCC<br>CGAGCGGTTCGACCCGGACAGCTACGGCGGCAACTACGACGGCTACG<br>CCGGCGACATCTGGAGCCTGGGGCTGACGCTGCTGGAGCTCTATCTG<br>GGTCACTTCCCGCTGTTGGGTCCCGGCCAGAGGCCCGACTGGGCGAC<br>GCTGATGTGCGCGATCTGCTTCGGGGAGCCGCCGAAGTCGCCCGACG<br>GGTCGTCGGAGGAGTTCCGGAGCTTCGTCGAGTGCTGCCTGCAGAAG<br>GAGTCGAGCAAGCGGTGGTCGGTGGCGGAGCTGCTGAACCACCCTTT<br>CATAGCCGGCGGTAAAGATCCGGCGGGATCCTTGTGAGGTGGAAGCA<br>CGCGGGTCGGGTTGAGGCAAAGTATTTTACCGCTGGAAAACCCGGAA<br>GTCGAGGCGGGCGCACGCAGAACGGGCCCGCCCGGGACAAATCAAGT<br>ACGGGTCGGGTCGAGATTCGCTTCGCGATGAGTTTTTGTACATATAG<br>GGCGGACTTCGGGTCGCAAATTCGGGCGCTCTCTGTTTCTTTTTTCT<br>TTTTCAATGTCCTCTTTAGGATGCTTCGGGCAGTGAAATTGCTGTTC<br>GAGAACTAATGAAGGACCCTTCTTGACTAGTTCAAAAAAAAAAAA |
| 65 | GCGGAAAACCCGAATCCCGGGAAAAAGAAACAAGCCTCGAGATCACT<br>GATCAGAGAGAAGGAGGGAGATGGTGAGCGCAGCGCAGGCGGCGG<br>GCGGGAGCCTGAGCCTGAGCCTGAGCCTGCGCGATCGCGAGATCCTG<br>ACCTCGGTGAACTCGGTGGCGTCGAGCTTCTCGCTCCTCGGCTCGGG<br>CTTCATCGTCCTCTGCTACCTCCTCTTCAAGGAGCTCCGCAAGTTCT<br>CCTTCAAGCTCGTCTTCTACCTCGCCCTCTCCGATATGCTTTGCAGT<br>TTCTTCAACATAATTGGTGATCCATCCATAGGATTCTTCTGTTATGC<br>TCAGGGTTATACCACCCACTTCTTTTGTGTGGCATCCTTTCTTTGGA<br>CAACAGTGATTGCATTTACTCTTCACCGGACTGTCGTTAGACACAAG<br>ACTGATGTTGAAGATTTGGAGGCTATGTTTCACTTGTATGTATGGGG<br>CACATCCGTGGTTATGACCATCATACGCTCTATTGGCAATGATCACA<br>GACATTTGGGTGCATGGTGCTGGTCACAAACAGGGCGCACAGGAAAG<br>GCAGTTCACTTCATTACGTTTTATGCGCCACTCTGGGGAGCAATCCT<br>TTATAACGGTTTTTCATACTTTTCAAGTGATACGCATGTTAAACAATG<br>CCACACGTATGCCGTTGGCATGTCAGATCGAGCATACCACTTAGAT<br>GCAAGACCTGATATGAAGGCTTTGAACAGGTGGGGATACTACCCGCT<br>CATTCTGATAGGATCATGGACTTTTGGTACAATCAATCGCATACATG<br>ACTTCATTGAACCTGGACATAAGATTTTTTGGCTGTCTCTTCTTGAT<br>GTTGGCACTGCTGCTCTGATGGGTCTGTTCAACTCAATAGCATATGG<br>CCTGAATTCTTCCGTGCGACGGGCGATTCGCGAGAGATTGGATCTAG<br>TAACGTGGCCGGAGACGATTAGGCCATGGTTGCCTAACAGTTCAAGG<br>ATCAGACACCAACAGCAAGAGAGTGAACTAGTGTCACTGAAAAGCCA<br>AGATCCGCACTGACGATTCCAAGATTATGCCCATCTTCTTCGACGAG<br>TGGTCGAGTATAGCCATGGAGCTACTGGTTTTGAAACCCTCATCAGA<br>CTGATCCAAAGTTCTGGTAGATGCTCACGGGATGGACCTTCTTCTGT<br>CATTTTAATGAAACAGCCGGTAATCTTTTCGCGACAAAGGGGTAGCG<br>TTGCCCATCTGCAACTGGTAGCTGCAATCTTGTACATTAGGAAGGTA<br>AAAAGCCCTTTTTGCGATTGTGATTCCTTCCTCCGCTGGGGACTCGG<br>GTGCCGGCTCCCCATTTTGTAGGTCGAATTGTACAACAATCTCTCGT<br>CTCCCTAATATCCGTTACGATCATATTCTTTCGACAATAGACTGATC<br>CCTGACTGCTTTACGTTGTTTCAAAAAAAAAA |
| 66 | GCTCATATCGAACCTGTTCCTTCTGGATCATGTGAATCGATTGACCA<br>AAAGAGGAGCGTTTTCTCATCGTCTTCCTCTTTGTCGCAGTTTGTCT<br>CGAGCTGTAAGGAGATTCGCCACAATGTAGCCGTCACGGCTCGTCTC<br>GAACTGTAAGGAGGCGAGATTCGGAAGTACTCTGGGAAATGGCGGGC<br>CTTTCGGACGATCTGATCACCAAGATACTGGACCGATTCCCGAAGGA<br>ATCGCTGATCCCCTTCAGGTGCGTGTCCAAACAGTGGCGTCGCTTGA<br>TAGACGACCGTTTCTTCAGGAAGTCGCTCCTCTACCTCGTCCCCATG<br>TATTCCTCGAGTCTCTACCGTATCGGTCTGCGTCGCCTGGGTGACTT<br>GGTGGAGATTGAGAACCCTTTCGAGTCGGAACAGATCGTGTTGTTGG<br>GGTCTTGCCGTGGCTTCCTTTGCATTTATAATGAGATCGACGGCCAG<br>ATTGCTATATGGAATCCGTCCACTAGGAGTTGTCAGCTCTTGCCACC |

TABLE 2-continued

Cell Signaling Gene Sequences

| SEQ ID NO | Sequence |
|---|---|
| | TGCAGATGCTGAGATAGCCCATAGATTGGGTCCCCCTGCTTGCGTTT |
| | ATGGATTTGGATATGACTATTGGAATGATGAGTTCGTGTTGTTGAGG |
| | CTGGTTCAGACCATGGAAGATCCAATTCTATCAGTTAGCATCTATAG |
| | ATCAAGAGGTAGCGTGTGGAGGCGGCTCCAGGGGATACCACCATACT |
| | CTTTGGTTGAACCGCGCACAATGGGGGTTTTCTTGCGCGGCCGTCTG |
| | CACTGGATAATGAGACGCGACCCGATGCAGAACTCGGCAATAGTTCT |
| | GGTGGCTTTTGATATTCATACTGAAAACTCCGTGGAGGTACAACAGC |
| | TTAATTTTATTGACAATAGGCTTCCAATGTATTTGGCCATCCTGGAA |
| | GGGGGTCTTTGCCTTATTATTAATGATGAGCGAGGGGGTGTCAGTGC |
| | GTGGATTGCAAGTGAATATGGATCGGAAGAGTCATGGGCTAGGCTGT |
| | TCTCGATAGCTGACTACTCGATGGGTCGGGTACTTCTCCAGCCACTG |
| | GCTTACTCCCAGAACGGTCGTCAAGTTTTGCTCCTGTACCGTGAGAC |
| | TCTCGTTTGGTACGATTTAGATACCGGTGACGTTGAGAATATAAACA |
| | GCATGCTAAGCATCTCCAATACACCTATTGTTGGAGACTACTTAGGG |
| | TCTCGTCGTCGGAGACTACAAGGTGCGTGGAGGCAGCTCGAGGGTAT |
| | GTCGTACTCTCTGGGTAATGCGTGCAAAAGGGGGATTTTCCTGCATG |
| | GCCGTCTGCACTGGATAATGACTCTCCAGCTGGTGCTGAATTCGACA |
| | AAAGTGTTAGTGGCTTTTGATATTCGTTCAGACAAATTTATGGAGGT |
| | GAGCGAGCTTAATTTTATAGATAATAGGCTCAACATGGATTTGACCC |
| | TCTTAGGAGGGTGTCTTTGCCTTATCATTTATGGTGAGCAAAGGGGT |
| | GTCCATGCGTGGATTATGAGGGAATATGGATTAAACAGACCATGGTA |
| | TATGTTGTTCTCGATGCCTGGCCACTCAAGGCCGCTATTGGCTTACT |
| | CCCAGAACGGTCGTCAAGTTTTGGTGGCAGTGGGCGGTAAGACTCTC |
| | GTTTGGTACGATAGAGTCTGGTACGATTTACATACTGGGGGTGTCAA |
| | GAAGTTCGGTAAAAGGGGCATGCCAAGTTCCTATGAAGCAGAAATTT |
| | ATTTGCGAACCCTTGTTCCGGTCGGTAAGCCGCCGATATGAGGAGGG |
| | ACGACTTCTGAGCTAATGACTTGTTTGGAGGATCGTCGATGATCTGC |
| | ATCGTAATCATCCAAAGTGAAGTCAAATCTGATGTAATCTGGAGTGT |
| | ACTCTGAATGCGTGTTGTGGTTTGAATGTACTTAGATGCCAGTAGTT |
| | TCTAGCCTGTTGCATCCGCTTATTTGCTATATTAACGTATATTCAGC |
| | AAAAAAAAAA |
| 67 | GGTGTTTATCGCGTGCTGGAAACAACGAAGGAAGGAACGAAGGAAGC |
| | ACTTCGCGTGCTGAGATTACTTACTCTCTTCGGCGGCGTCCCGGGCG |
| | AGAGCTCCGATTCGGTTCGATTCGATTCGATTTGCGATGGCCGGAGG |
| | AGAAGCCTTCTCCTCGAATCCTCCGCCGCCCAAGCCGGCGATTCTCG |
| | GGAACAACAGCAAGACCATCAATGCGAAGCTCGTGTTGCTGGGGGAC |
| | ATGGGTGCCGGCAAGTCCAGCCTGGTCTTGCGCTTCGTCAAGGACCA |
| | GTTCTTTGATTTTCAGGAATCAACTATAGGAGCAGCATTCTTCTCGC |
| | GGACAGTGGGTGTCAATGATGCATCAGTGAAGTTTGAGATATGGGAT |
| | ACTGCAGGTCAGGAAAGGTACCACAGCTTGGCTCCTATGTACTACAG |
| | AGGCGCTGCTGCAGCTATTGTTGTCTATGACATCACTAGCACCGAGT |
| | CATTTGAACGGGCTAAGAAGTGGGTGGAGGAACTTCACAAGCAAGGA |
| | AATCCCAATTTGATAATAACACTTGCTGGAAATAAGACTGATATGGA |
| | GGATAAAAGAAAAGTGGCAGCTGAGGAGGCATGCATGTATGCAGAAG |
| | AAAGGCGACTCGTGTTCATAGAAACATCTGCTAAGACTGCCACTAAT |
| | GTTAGCAAACTGTTTTATGAAATAGCAAAGAGGTTGCCTAGAGTTCA |
| | GGCTATGCAGAATTCAGCGCCAGCGGGAATGGTTCTAGCAGATACAA |
| | GCTCTGAAGAAACCCGATCTGCATCCTGTTGTTCATGAGTTCTTATC |
| | AACTCTCTGTCCATTCCTTTCCTTTTTCCCCTCACTTTCTATAGTTG |
| | TCTCCACTCAAAGTACCTTGATCTTTTAGTTCTTGATGTATATGAAT |
| | AAAAACAAATCCGAACACCACTTGTGAAATTGGAAAACCAATTGGAG |
| | TTGGGGAGTTAGTCCATTTAAACCCAGTAAATTCCTCGGTGAAAAAA |
| | AAAA |
| 68 | GGGAGAGTTCAGAGGTAAAGGAGGAAAGCAAAAAAATGGAGATTCCT |
| | ATGATAGATTTGAGTGAGCTTGATGGTAAGAACAGGAGCAAAACAAT |
| | GGCACTGCTTCACCATGCTTGTGAGAAATGGGGCTGCTTCAAGATTA |
| | AGAACCATGGAGTTGACCCAGAACTGATGGAGAAAGTGAAGCATTTT |
| | GTCAACACCCACTATGAGGAGAATTTGAAGGCAAGTTTCTATGAGTC |
| | AGAAACTGCCAAATGCTTGGAAATGCCAATGGTGCCACATCTGATCT |
| | AGACTGGGAATGCACCTTCTTTATCTGGCACCGCCCGAAGTCGAACA |
| | TTGAGGACTTCCCGAACCTCTCGAATGATCTTCGGAAGACAATGGAT |
| | GAGTACATTGCTCAGCTGGTTAAACTAGCAGAGAACCTCTCAGAGCT |
| | CATGTGTGAGAATCTTGGCCTAGGCAAGGACCACATAAAGAGGGCAT |
| | TCTCAGGGAAAGATGGGCCCTCTGTGGGGACGAAGGTGGCGAATACC |
| | CGGAATGCCCCTATCCGGAAAAGGTAAGAGGACTCAGAGAGCACACT |
| | GATGCAGGTGGTATCATACTGCTGCTTCAGGATGACCAAGTCCCAGG |
| | ACTTGAATTCCTCCATGATGACCAGTGGGTTCCAATCCCACCATCCA |
| | CAAACGACACCATCTTCGTCAACACCGGAGACCAACTTGAGGTGCTG |
| | AGCAACGGCCGGTACAAGAGCGTCTGGCACCGTGTCATGGCTGTGGA |
| | GAGCGGGAGCCGGCTCTCTGTGGCCACGTTCTACAATCCCGCCGGCG |
| | ATGCGATCATCTCGCCTGCGCCGAAGCTCCTGTACCCTGAGAAGTAC |

TABLE 2-continued

Cell Signaling Gene Sequences

| SEQ ID NO | Sequence |
|---|---|
| | ACTTTTGGGGAGTACCTGAAGCTTTATGCCACTACCAAATTTCAAGA<br>AAAAGAGCCCAGGTTTGAGTCGATGAAGAGTGTGATGAGCAATGGAT<br>ACAATGGAGTTGTCTAAGAGCTGCCAATAACTAAATGGATCAGGCTC<br>ATTTGTCTCTGTTTGGATTTTGTTTTTACTTTTTCTTGCTTTGATAG<br>AAACATGGTCTTGTGGTTATATATGCCAGTTGTCTCTTTTACAGTGA<br>GTTTTGTGTAACTCCTAAAGAAGAGATGGTATAAGTCTGTCTTTATC<br>AGCTTTCTTGGCTCTCTTTGTGCTGATGTTGAATGGGCTCCAATGAA<br>AAAAAAAA |
| 69 | AATTTCCTGGGTGGCTGCATTTTCTTTACTGGGCTGCTGCTGGAGAG<br>ACAGAAGAGGAGGAAGAATTCATGGCTACAGTTCCTCAAGAAGCGAT<br>CAATGAGCTCCAAGCTCTGATGGATCGAGTTGACGAGCCGTTGATGA<br>GAACATTCGAGAACATTCATCAAGGGTATCTTAAAGAAACTTTGGTG<br>CGTTTTCTAAAGGCGAGAGAAGGCAATGTTGCCAAAGCCCATAAAAT<br>GTTATTGGATTGTTTGAAGTGGCGTGTTCAAAATGAGATTGATATCA<br>TTTTGTCGAAACCAATTATCCCTGATGACTTGTACAGAGCTGTGCGG<br>GATTCACAACTTATTGGATTGTCAGGTTACTCCAAGGAGGGACTCCC<br>AGTATATGCTATCGGGGTTGGGCTTAGCACCTTTGACAAAGCTTCAG<br>TTCATTATTACGTGCAATCACATATTCAAATCAATGAATACAGAGAC<br>CGTGTAATTTTGCCTTCTGCATCCAAAAGGTACGGGCGACCTATTAC<br>CACTTGTTTGAAGGTTCTAGATATGTCCGGCCTGAGGCTTTCAGCCC<br>TCAGTCAGATAAAGTTGTTGACTATTATATCGACTGTTGATGACTTG<br>AACTACCCTGAAAAGACGAATACCTATTACATTGTGAATGCTCCATA<br>CGTCTTTTCTGCTTGTTGGAAGGTTGTGAAACCACTTTTGCAAGAGA<br>GAACGAGAAAGAAAGTTCAGGTGTTGCCTGGTTGTGGACGTGATGAT<br>CTACTAAAGATAATGGATTACAGTTCCCTCCCACATTTTTGCAAGGG<br>GGAAGGTTCGGGTTCTGGTCGGCATACATCATACGGTCCAGAAAATT<br>GCTACTCGTTGGACCATCCCTTTCACCAACAGCTTTACAGCTATATC<br>AAGGAGCAATCTCAGAGACGTCAACCCATCCAACCCATCAAACAGGG<br>CTCTTTTCATGTTGCGCTGCCTGAGGCCGCTGCAGAAGGGACAGAGA<br>TCGCTAAAACCATAGAATCCGAGCTACAGAAGTTTGAAAACGGAAGT<br>GGGATGCCTGACTCACTGGATGGCCTTAAAATCAATGGCGAGTGAAG<br>CCGTTGGGATCAAAATGCTTCGGACGACCATTTGCAGCGATGAATCT<br>AACAAGAGCTGATCATTGCCTTGATTCAACTACGTGAACGATGATGT<br>GTGGGCATTTCCAGTCACGCGACGTAACAGCACAGTATGGGTGGCT<br>CTCCCTATTGTCTATGTTATCTTCTTGAGGTAACCTGATCCAGCCGG<br>ATGTACCTTAGTGTACTGAATAGCCTAAAGCCATGTTCCTATCAGAT<br>GTATGACCTGGCATGTTGTAATATTCATTTCCATATGCAAGTTAACA<br>TCATTTCCACCTAGGGATCTCTTGGAGGCTCTCAGATTTTAAAGGAG<br>ATGTTCCTCATCTTCTTTACACGATATGACTGTCGGATGTTGCAAAT<br>GTTTACTAGCAAGTCTAGCTAGTCAATGTCTTCGGTTTCGTTGTTCA<br>AAAAAAAAA |
| 70 | GGATGGCCCGAGCGGGAACAAGAACATACAAGCCAAGCTGGTACTT<br>CTTGGGGACATGGGAGCTGGAAAAACAAGTCTGGTGCTGAGATTGT<br>CAAGGGCCAATTCCACGAGTACCAGGAATCCACTATCGGCGCAGCCT<br>TCTTTTACTCAGGTCTTGTCCCTGAACGAAGCGACTGTGAAGTTTGAT<br>ATATGGGATACGGCCGGACAGGAAAGATATCACAGCTTGGCTCCAAT<br>GTACTATCGAGGTGCTGCTGCAGCTGTCGTTGTCTATGACCTCACTA<br>GCATGGACTCATTTCAACGAGCCAAAAAATGGGTTCTAGAACTGCAG<br>AGACAAGGGAATCCCAAGTTAATAATGTTCTTGGTGGCGAACAAGGC<br>GGACCTGGAGCAGAAAAGGCAAGTGCTGAGTGAGGAAGGCGAGCAAT<br>ATGCTAAGGAAAATGGTTTGTCGTTTCTTGAAACTTCAGCAAAGACT<br>GCACAGAATGTCAATGAGCTTTTCTATGAGATAGCGAAGAGAATTGC<br>AAAAGCTACTCCTTCACGACCGACTGGAATGAAGCTGCAGAGACAAG<br>AAAGTCGAAGAAGCTTATTTTGTTGCTCGGGGTGATTCCAGTGCTTG<br>CTCTCTTAAGGAAATTGCTGCGAATGGCTGTGGTGGATGCACCTCTT<br>GTGGTTGTCGATGTTGAAGATGGAATCTCATTCTGACCCTGGCTCGT<br>GAATACTTTCATATGTACACAGTATTTCACCGGACAAAATCCTTTGC<br>TTACCATTTCAATTGTATCAAATTCTCCTTCATGTGGAAAGGGTTAT<br>GAAAACTCGTAAGCAATAAGAAATGTTGCTCCAAAAAAAAAA |
| 71 | GTCGGAGGGGAGTAACCATGTCGACACTCAGCGAAGACGACGAAACC<br>GAAATCCTCCTGCGGCTTCCCGTGAAATCTCTGCTCAAGTTCAAGAG<br>CGTGTGCAAGCCATGGAACTCACTGATCTCCTCTCCCTATTTCGCCA<br>AGACCCATCTTCAGATTTCCGCTTCTTCCCCAAGAATCCTCCTCGCC<br>ACCAACCCTCCTCTGTCCGTGAGCTGCGAATCACTCCATGATGATGA<br>TCGTGCCGGCCATGAAGGTACGCCTCTAACCCAGCTTCGGCCTCCGG<br>TTGAAGCTCCCGACGGATGTCGCCCCCGCATCGTCGGATACTGCGAT<br>GGTTTGGTCTGCTTGGAGTACGACGATCATCGGATTGTTGTCCTGTG<br>GAACCCCGGCAACAGGGGAGTCTAGAAACATCCCAAACGCTAGCTGCT<br>CGTATAACCGACCGACCATTTGCGGACTTGGCTATGATCCATCGACT<br>GATGATTACAAAATATTGCGGCACTGTTCCGTTGCGGATGCGTATGG |

TABLE 2-continued

Cell Signaling Gene Sequences

| SEQ ID NO | Sequence |
|---|---|
| | GTTTCCAGAATATAGCGTGTTCGATGTTTTCGCGCTGAAGACTGGTT
CTTGGAGGAGAGTTCATGACAAGCATGATGAATTTAACTATTGGCCG
GAAGCTGGGACCTATGCGAATGGTTTCCTTCATTGGCTAGTCGTGGG
GAGAGATCCTTGGGAACACAAGAAGATTGTTTCGTTCAGCATGAGCA
AAGAGAAGTTTGAGGATGCGTTGTTGGCGCTGCCGGAGGCCAATGAA
GGTACTGGGTTCAGAGTATTGGGAGTTGCCGGTGAATGCCTTCTCAT
ATATAAAAGCATGGCGGAGGTGGACACTTTTATGGCATGGATGATGA
GCGACTATGGTGTGAGATCGTCGTCGTCTTGGATGGAGTTGTGTAGT
GTTACTCTCCCGAATCAGACATTAAACACTTACTTCTACATGAGGCC
ATTGTGCTCTACCAGAGCAGGGAAGATAGCATTCAGTTCGATCGGCA
CAACCCGCTTATCTATGATCCTGAGAAATGTTATGACAAAGTGGTTC
GTGAAGGAGGATAAATTAGACTTTGTAGTGTACGTTGAGAGTTTTGT
TTCACCTCATGGAGCAAAGCTGCAGAATCAATATGTGTCTCGGGTGA
AGGAGCCTATGGAGAGAAGTGACTTCATTGGTGATCACTCAGTATTT
AAAGAAGGGGAAACTTCATATAAGAAAGCCAATAGCCATCTTAGCAG
TAAAAGGAGAAAAGCTTCCTAGAGGGCTAGTTGTGATGTGGATGCGC
AGGTCGATATATTGTGAAGTCAAAGGGGTGACTCAGTAACTGCTTTA
GGCACTTTGTTCTTCTCTTTTGTGGGTTCCTTCTGGATTACTTTGTG
TGTCTGTGTTTGGTCGGGATGGCAGACTTGTTTCTTTGTTTACTTGT
ATAACATTTTTGTAATTCCTCTTTCCACAAATCAAAGCCCTGATGAA
AACCAAAAAAAAAAAAAAAAAAAAAAAAA |
| 72 | AGAGAGAGAGAGAGAGAGAGAGAGAGATGGAGATATTCCCAGTGATT
AACTTGGAGAAGTTGAATGGCGAGGAGAGAGGAGTTACTATGGAGAT
GATAAGAGATGCTTGTGAAAACTGGGGCTTCTTTGAGTTGGTGAATC
ATGGGATATCCCATGAGCTGATGGACACGGTGGAGAGGCTCACAAAG
GGTCACTACAAAGAATGCATGGAGAGGAAATTCAAGGAAATGGTGGC
AAGCAAAGGGCTCGAGGCCGTTCAGTCTGAAATCGGCGACATTGATT
GGGAGAGCACCTTCTTCTTGCGCCATCTCCCCGTCTCCAACATCTCT
GAAGTCCCTGATCTCAAAGAAGATTACAGGAAGGTGATGAGAGAATT
TGCACTGGAGATAGAGAAGCTAGCAGAGCAACTTCTAGACCTGTTGT
GTGAGAACCTCGGTCTGGAGAAAGGGTACCTGAAGAAGGTGTTCTAT
GGATCCAAAGGGCCAACATTTGGAACCAAGGTGAGCAACTACCCTCC
GTGCCCGAACCCAGAGCTTTTTAAGGGCCTCCGGGCCCACACCGACG
CCGGTGGGATCATCCTTCTCTTCCAGGACGACAAGGTCGGCGGCCTT
CAACTCCTCAAGGACGGCAAATGGATCGATGTCCCTCCACTGAGGCA
TTCGATTGTCATCAACTTAGGCGACCAGCTAGAGGTCATTACAAATG
GCAAGTACAAGAGCGTGGAGCACCGGGTTATTGCGCAGTCAGATGGG
AATAGAATGTCCATAGCATCGTTTTATAACCCTGGAAGCGATGCTGT
CATCTGTCCTGCACCAGCACTATTGAAGAAAGAAGCAGGAGAGGAAG
GCCAAGCTTATCCCAAGTTTGTGTTTGAGGACTACATGAAGTTGTAT
GCAAGGCTTAAGTTCCAGGCGAAGGAACCGAGATTCGAAGCCATGAA
AGCCACGGAATCCACCATTGCTAGGGGTCCTATCGCAACTGCTTGAG
TGTTGAATGACAAGTTTCTTGTTACTAAGAATAGGGTCTTGTTTCAT
GGTCTACTAATGTAATGAATCTCGCTCTTTATCTAGTGCTGGAGAGT
GGCTGCTTTGCTTGTGTTAAGTAATGTGTTTATCATGACCTTTGAAC
TAGTGATTTCTGAGGCTTTTTATTTGAAAAAAAAAA |
| 73 | ATCCTTCACTCCGACTCTCCACCCCCACCATCTCCTCCTCCGCCACA
CCACTACCAACACCACCACCATCACCACCATGCAAGTCTCTCAACCT
GCTCGTCCTTCCGATCCAATATACAGGCGAGACGATCACTTGTCACA
AGCATGCAAAGACTTGGTGTCCTCTCTCCCTTCTGAAGAAGGCTGGG
TCGCAACCTCTTTCTGCTTGTACCAGGGCTTCTGGTTCCCCACTTGG
CTCTTCAACGGTGTCCTCGCTTGCCAAAACCACTTCCAAGCTCAACC
CTCTGACATCCTCCTCGTCACCAACCCGAAATCCGGCACCACCTGGC
TAAAGGCCATCCTCTTTGCTCTCTTGAACCGTGCCAAGTACTCTGAC
TCCGACTCAAAACAACGCCACCCTCTTCTAACCCAAAACCCCCACGA
TCTTGTGCCCTTCTTGGAGGTCAAGTTGTATCTCCAGCAAGAAAATC
CCGATCTCACTACTTTCGAGTCCCCGAGGCTCTTCGCCACCCACTTG
CCCTATTCGTCACTTCCAGGGTCGGTGAGGGACTCCAGGTGCAAGCT
GGTTTACCTGTGTAGGAACCCTAAGGACATGTTCATCTCGCTGTGGC
ACTACGTCAACAAGCGGAGGGCCGAAGAGAAGGGCCAGATTCCGCTC
CCAAAGTGCCTTGACAAGTTCTGTCGAGGATTGAGCCCCTACGGGCC
TTATTGGGATCATGTGATGGGTTACCACAAGGCGAGCTTGGAGATGC
CTGAGCAGGTGTTGTTCTTGATGTACGAGGAGTTGAAAGAGGACCCG
CGTGTTCATGTGAGTAGGTTGGCTGATTTCTTGGGGTGTCCGTTCAG
CGATGAAGAACTGAGAGACGGCACTGTAGAGGGAATAATGAGGATGT
GTAGCTTCGACAATTTGAGCTCATTGGAGGTGAATAAGAGCGGGAAG
CTGTGGACTGGACAAGAGAACCAGTGGTTTTTCAGGAGAGGGAAGGT
CGGAGACTGGGTGAATTATCTGAGTGCTGAGATGGCCGACAAGATTG
ACCAGGTAATGGAAGAGAAGTTGCGTGATTCTGGGTTGAAACTTTCA
GTACAAATAACTCACTCGTTCAATAATTTCCGTGGGCTGTGTTAATT
TTAAAGATGTTTGGTTTGATGGTGGAGAAAAAAAGGCACAAAAAGTT |

TABLE 2-continued

Cell Signaling Gene Sequences

| SEQ ID NO | Sequence |
|---|---|
| | AAAAAGGAAAAAAAAGGAAACGACTCGTTTGTTCGCACTTTATGAAA<br>GTGTGATTCTTATGCTATAGGATCAAAGATTTTTAGTGGCAGTGTCG<br>ATCGTGGCTTCGTATCAATAATGAGACGCTTCAAGGTTGTGTTTCTG<br>GGCACCAGCTTTGTTGTACTATTGGCTTTTGCAGATGCTATTTGGCC<br>AACACTTAGTTGGCCAATAAAAAGCAGCTTTCCATCTTTTTCTTTTT<br>GCCGTGTGAAGCTTTGTGATGTATGGTCTTGTGTAGATCGAATTGCT<br>AAACAACTGATATGTGTGGTTTGGATTAAAAAAAAAA |
| 74 | TGGGGTTCTCTTTCTCTCTCTATAAGACGCATTGCTCCCTCTCCCTC<br>CCCCTTTTGGCCCTCCGTGCGCTCCAAAGCTCGCTCCTTTGAACCCC<br>GCGCGAGCGAGACGGGGAGGTGGGCAGCCAGCTTTTCGCCTTTCTCG<br>AACTGGGTCGGCTCCCTTTTTCCGCCTCCCGCCTCCCAGATCTCGCC<br>CTCGCCCCCTCGCCGGCGGCCGGGCAAAGGCAAAGGCAAAGGCAAAG<br>GCCGAGTCTTTTTGATCGGCCGGTGATGCTCAGCGGCTGACGTGGGC<br>CGCTCCTCCCCGGTTGCGCTGCCCGCATGGATCCGACGAAGAAGCCG<br>CGGGAGTCGTCCTCGTCGACGCGTCGGCGGCGGCGGAGTTCCC<br>GGACGAGGTGCTGGAGCGGGTGCTGGCGCTGCTAGCCTCGCACAAGG<br>ATCGGAGCGCCGCGTCCCTCGTGTCCAAGGCCTGGTACCACGCCGAG<br>CGGTGGTCCCGGACGCGGGTCTTCATCGGGAACTGCTACTCGGTGAC<br>GCCCGAGATCGTCGCCGGCCGGTTCCCGAAGATCCGCAGCGTCACGC<br>TCAAGGGGAAGCCCAGGTTCTCGGACTTCAAACCTGGTGCCGCAGAA<br>CTGGGGGGCCGACATCCGGTCGTGGCTCACGGTCTTCGCGGAGCGGT<br>ACCCCTTCCTCGAGGAGCTGCGGCTCAAGAGGATGACCGTGACGGAC<br>GAGAGCTTGAAGTTTCTGGCCCTGAAATTTCCAAACTTCAAGGCTCT<br>CTCGCTCATGAGCTGTGATGGGTTCAGTACCGATGGTCTTGCGGCCA<br>TTGCGACTCGCTGCAGGAATTTGACTGAGCTGGATATACAAGAGAAT<br>GGCATTGATGATATTAGTGGTGACTGGTTGAGTTGCTTCCCTGAGAA<br>CTTCACATCTTTGGAAGTGCTGAACTTCGCAAGTCTAAATAGCGATG<br>TTGATTTTGATGCTCTTGAGCGGCTTGTAAGTCGGTGCAATTCACTG<br>AAGGTCCTTAAGGTTAATAGAACTATTTCACTAGATCAGTTACAGAG<br>GCTGCTTGTCCGTGCTCCTCGGTTAACTGAGCTCGGTACTGGCTCGT<br>TTTTGCAAGAGCTTAATGCTCACCAGTACTCAGAGCTTGAACGAGCT<br>TTTGGTGGCTGCAAGACTCTACACACGCTCTCTGGATTATATGAAGC<br>TATGGCACCATATCTCCCAGTTCTATACCCGGCCTGTGCAAATTTGA<br>CTTTCCTGAATTTAATGATGCTGCTTTGCAAAATGAAGAACTTGCCA<br>AGCTTGTTGTTCACTGTCCATGTCTTCAGCGCCTCTGGGTACTTGAC<br>ACTGTGGGAGACGAAGGGCTGGGAGCTGTTGCGCGGAGTTGTCCACT<br>CCTAGAGGAGCTTGGGTCTTCCCGGCCAACCCTTTTGACGAGGAAG<br>TTAATCATGGTGTTTCCGAATCAGGGTTTCTTGCCATTTCATATGGC<br>TGCCGGAGACTTCACTATGTACTCTACTTCTGCCGTCAGATGACAAA<br>TGCAGCTGTAGCCACAATTGTGCAGAACTGCCCTGATTTTACACACT<br>TCCGTCTTTGCATAATGAACCCAGGGCAACCTGATTATCTGACAAAT<br>GAACCTATGGACGAGGCTTTTGGTGCAGTTGTGAAGAGGTGTACGAA<br>ACTCCAGAGGCTTGCTGTTTCAGGTCTCCTAACTGACCAGACATTTG<br>AGTATATTGGGACATATGCTAAAAATCTGGAAACGCTTTCTGTAGCT<br>TTTGCTGGAAGCAGTGACCGGGGGATGCAGTGTGTGCTGAGGGGTTG<br>TCCAAGTTGAGAAAACTTGAAATCAGGGATTGTCCATTTGGTAATGC<br>AGCTCTTCTCTCGGGATTGGAGAAGTATGAGTCTATGAGGTCGTTGT<br>GGATGTCGGCCTGCAAAGTGACAATGAATGGGTGTGCGGTATTGGCT<br>AGGGAGAGGCCTAGATTGAATGTTGAAGTAATGAAGGATGAGGAGAG<br>CAGTGATGGTCAGGCATATAAAGTTTATGTTTACCGCACTGTTGCTG<br>GACCAAGGAGAGATGCCCCACCTTTTGTTCTTACTCTCTGAAGTGAT<br>TATTTCAAGGCATTTGTTGCTATGTGAATTTGTCTGATTGAAGTGGG<br>GAGCACCGGTGCAGAGAGTCTGAGGGTGTGGAATTCACAGAAAGCTC<br>GAACATTCTGTTACCTATGTTTCTGCGGTTCAGCTAATTCCAGATTG<br>TGAAGGCACACAAAATGGATAATCTGGTGGGAAAAACAACGTGTAGT<br>GTCTGCCTCCATTTGCTTGAAGGTGCTGGAAAGCGTATGATGCAGTC<br>GGTGAGATGAGTTCAAAAGAAACACCAGAGATCTGCCAAAATGTCT<br>CGAAGCATCGGCCGACAGCTCGGGGACTTGAACCCATGAAATTTTCC<br>CCTTGCAAGCGCATCAATCTCTGCAACATTCTTCATCAATTGCAAGA<br>CATCATCAACAGCTGGGAGAAAAGATGATGATTTTCCTGATGTTTTG<br>ACTCATCTTTCCCTGGTGACTTCCATCCACAGCAATTGCAAGGAATC<br>CTTTATGGATCTCTCGCTTGCAATGTATG |
| 75 | ATTTTTTCATGGGGATCGTCAAGCTGATAAAACCGCACGAGGTTCTG<br>ACGAGTCCGGATAATCCCCTTTTAATTAATCAAGCTTGATTAAACCG<br>CAGCTTAATTTAATTAAGTTGATTAATTAAATCGGATTCCCCGAAAT<br>GGGATGACGTGCTATAAGGACGTAGCCACTGCCGTCCGCTCGTGCAC<br>CCAAGGCGCAGCACCGCACGCTCTCTCTCTCTCTTCTTTCTCTCTCT<br>ATCTGCGCGTCCCGACTTCTGGTTCGAGCTTGTGCTTAGCTTTGCAA<br>GAGCAGACGAAGCCGAGGTGAGAGGATCGAGCAGCGTTGCAGCGGAG<br>CGACCGGGCGAGCATGTCGTCGTCGGCCGTGCAGTTCGCCGCCGCTT<br>CTCGCGACGGCCACGAGAACAACGGCGGGGGCGGAGGGGACAGCAGC |

TABLE 2-continued

Cell Signaling Gene Sequences

| SEQ ID NO | Sequence |
|---|---|
| | GGCGAGCGGCTCGACCCCACCGCCGTCCTCCTCCCCGTCGATCCCGG<br>GGCCCCCGACCTGTCCCTCCCCCGGGAGACCTTCCTCCGGGCGGCCC<br>TCTCTCTCAAGGACCAGGTGGTGCAGGCGACGTGGCGCGAGGGCGGA<br>GCGGCCGATCCGACCGCGTACACGGGGCTGCTCGGGACGGCGTTCCT<br>GTGCCTGAGGTCGTACGCGGCCACCGGCGACCGGGGCGACCTGCTGC<br>TGTCGGCCGAGATCGTCGACGCGTGCGCTTCCGCGGCGCGTGCTTCC<br>ACGAGGCATGTGACGTTTTATGTGGTAAAGGAGGGGTGTTCGCGGT<br>GGGCGCGGTGGTTGCCAATCTTCTGGGGGACCATCATAAACGTGACT<br>TCTTCCTCAACCTATTCCTCGAGGTGGCACAAGAGAGGGCTCTCCCG<br>GTTGGACCTGAGGAGGGCGGTTTTGGGATGTCGTACGACCTTCTCTA<br>CGGCCGAGCTGGTTTCCTGTGGGCGGCTCTATTTCTGAACAAGAACC<br>TGGGAGAGGAGACGGTGCCGAACAATGTTCTGATGCCTATTGTTGAC<br>GCCGTGCTGGCTGGGGGCAGGGCCGGTGCGTCCGATATCGCTACGTG<br>CCCATTGATGTACAGATGGCATGGGACCCGGTACTTGGGCGCAGCCA<br>ACGGCCTCGCTGGAATCTTGCAAGTGTTGCTTCACTTTCCACTCTGC<br>GAAGAGTACCTCGAGGATGTTAAGGGGACTTTGAGGTATATCATGAG<br>CAAGAGGTTTCCGCACAGTGGGAATTACCCCTCGAGCGAAGGGAACC<br>CGAGGGACAAACTGGTTCAGTGGTCTCACGGCGCGACGGGGATGGCC<br>ATCACTCTATGCAAGGCATCACAGGTTTTTCCACATGACAGAGACTT<br>CCGTGATGCGGCCATAGAGGCGGGGAAGTTGTGTGGAAGAACGGGC<br>TCGTGAAGAAAGTGGGGCTTGCTGATGGCATTTCAGGGAACGCGTAC<br>GCCTTTCTCTCGCTGTATCGCTTGACGGGGGAGAGAATCTACGAGGA<br>CAGAGCCAGAGCGTTTGCGAGCTTCCTCTACCACGATGCCAACAAGC<br>CCGTCGGCACGGGCACGGGCACGTTGCGGACTATGCCTTCTCCCTC<br>TACCAAGGGCTCGCCGGGGCGGCTTGCCTCTGGTTCGATCTCGTTGA<br>CGCGGAGAACTCCAGATTCCCAGGGTACGAGCTATAAGGGAAGGAAC<br>GCGAATGCGAACACACGAGAGTTTACGTATAGCTCTTTCGTGTGTACAT<br>ACTAATGAGAGGTATGCCGTTACAAATCACGTACGCTGTTGCTCTAT<br>TGCTACAGTCAATATATGTAAGGATTGCAACTTGACAATCCCACGTT<br>TGAGGCAAGAAATTGGTATCCGAAAAAAAAAA |
| 76 | AACCATCAAGTTCAGCCTTCCCCGCCGTGCAGCACTTCACCTAGATG<br>CTTGTCGACGAATTCCAGTTGGCGACCTAAAGCGCTTCTCGACCAGC<br>CAGCAGTTGCCCAGACGATTTCCGGTGACCTCCGCGGCATCCCCACA<br>CCGGAGACCCTTCACTGCTGCAGCTGTCCTCTGCTGATTCCGGGCTT<br>GGGTTGCCATTCACTGTTGTTCCTCCTGCCGATTGCTGTTCGCTACA<br>ACAGATCACGACACCTGTAACATCGGCAAGCTCCCGGTTCGAAGGAC<br>CGCTCACAGACCTTCACGAATTCAAGATCCTCACGTATCCAAATTTC<br>TTGAAGAGATTAATAAAGGTGAGGCCTTGAAGGGATAAGTCCACCAT<br>CTGGAGAGCAGCCCGTGACTTGCCTCGTGTCCATGCCTACAAGGCCT<br>TGGTGTCATTGGTGTTAACTGTCCATTGAAGGAACACTCAACCCAGT<br>AGCGAACCAGCAAGCTACCTTGCTGTTACGCACATGTACTGACGAAC<br>CCAGCCTTGCCGAAATTTTTAGACGATCTCAACGACTCGCTCCTGCA<br>CCTCAATTGTGAACCCCCCACCTTCCGACACTAGCCGCCGTTCTTGT<br>TCGTATCCAAACCGAGTCGATTCTACGAAGTTCTTATTTTTGCAGGT<br>TCGTTCACCGTGAGCCCACGGTCGTCCTTTACTGAGGAGCACCACCG<br>TGCCGAGCTTCAAATTTTGTTCTTGTCGAGTTCAAATTTTGCAATAT<br>TACTTGTGAAAATTTAGGATTAATAGGCTTCAAAGCTTCTCCTTACA<br>AAGATGCAAATCTTGCCCAGTCCTGAAGAATCCATCACCTGTAGTGG<br>CCCGCACTATGACAGAGCGAAAGAAGCAAAGGAATTCGACGAGACCA<br>AAGCCGGCGTCAAAGGCCTCATCGACTCCGGCATGGCCAAGGTCCCT<br>CGGCTCTTCATCCACCCTCCCCAGAACCTGCGCGACTTGTCCTCTGA<br>CACAGAGGGGTCCGCCACTGACCTCAAGGTCCCCATCATCGACATGA<br>TGGGCTGTCAGGATTCCCAGCTGCGGCGAGACGTGGTCGACGACCTC<br>CGTAGAGCGTCGGAGACGTGGGGGTTCTTCCAGATAATTAACCACGG<br>GATCCCGGTCGATGTGATGGACGGCGTGTTGGAAGCTGTCAAGCAGT<br>TCCACGAGCAGCCTGAGGGAGTGAAGGGAGAGTGGTACTCCAGGGAC<br>GACGCTAGGAAATTTAGGTACTACAGCAATGGAGACTTGTTTTGGTC<br>CAAAGCAGCAACTTGGAAGGACACTCTCCTGTTTGATTTCCCGTTTG<br>GAGAGCCAGACCGAGAGGCAGTCCCTCTTCTATTCAGAGAAACGGTT<br>TTTGAGTACGAAAAACACGTGGAAAAATTGAAGGGATCTCTGTCTGA<br>ACTACTATCAGAGGCACTGGGGCTCGATTCAGGCTATCTTGGTGACA<br>TTGAATGCATGGACTCCAAGAGAATAGTAAGCCATTATTACCCAACT<br>TGCCCTGAGCCAGAGCTGACTCTGGGCACAATCAATCACTCAGATGC<br>CACATATCTCACTCTTCTCCTGCAAAACCACAATGGTGGCCTCCAAG<br>TCCGGCACCAGAACCAGTGGGTCGATGTCTCCCCGTGCCTGGAGCC<br>ATCCTAGTCATCATTGGAGACTTCATGCAGCTTGTTAGCAACGACAA<br>GTTCAAGAGTGTGGAGCACCGGGTCCTTGCCAGGCGGGCTGGGCCCC<br>GGGTCTCAGTCTTGTGCTTCCTCTTCCCAGGGGAGACGCGTAAGTCG<br>AAGCCGTACGGGCCGATAAAGGAGCTTCTCGACGAGAACAATCCGCC<br>CATGTACAGGGAGACCTCTTTCACAGAGTATTTTGGGTATTACCTCT<br>CCAGTGGCAATGGCCTCAATGGCGAATCTGTGCTTCCTCATTTCAGA<br>GTAAGCGAGCCCAAGTAGAGAGTAGAAAATGCAACAAAAATCTTTGA |

TABLE 2-continued

Cell Signaling Gene Sequences

| SEQ ID NO | Sequence |
|---|---|
| | AGAAGGTGTCGGCCTTCACATGAAATCCGATGGCTGTCTTTTCATTG<br>AATGTAGCGATAGGACCACACCTCGAAAAGAATAATCAGAATCTACT<br>TTGATTTGATCGAGACTGAAACAAGAAATTGCCAAAATATGATGGCA<br>TGCTCCTTCAGTCTCTGTGAAAGCATTTGAATCTCTTTCCCCTAAAT<br>TTATCGCGAGTTTCATCAAAAAAAAAA |
| 77 | ATAATGGATGCCGGAGATCTCGGTTCGGAGAAGTCTTCTGAGACCAC<br>GCGTGAGCTCGTCGTCATGTCGTCGAGATTTTCAGATGGGTCCTGCT<br>CTCGAGAAGTTTAGTGTCGGATGGATTGAACTGGCTGCCCAGCTTCA<br>ATGCAATGTTAAAGAAATTAGCTTCCGGGATTTTTATCTCTTCTG<br>CTCATTACCGTTTCAGTGGCTGATAATGGATTCCCACGATGCAATTG<br>CGATGACGAGGGAAGTTTGTGGAGCGTGGAAAGCATTCTGGAGTGCC<br>AGAGAGTGAGCGACTTCTTGATCGCCGTGGCCTACTTTTCGATCCCA<br>ATTGAATTGCTGTATTTTATTAGCTGCTCGAACATCCCGTTCAAATG<br>GGTCCTGTTTCAATTCATTGCCTTCATTGTTCTGTGCGGATTGACCC<br>ATCTGATCAATGGGTGGACTTATGCCCACCATCCCTTCCAACTCATG<br>GTCGCACTCACCGTGTTCAAGATTTTAACTGCTCTCGTCTCTTGTGC<br>CACGGCGATAACGCTCATCACCCTCATTCCTCTGCTTCTCAAAGTGA<br>AGGTGAGAGAGTTCATGTTGAAGAAGAAGGCTTGGGATTTGGGGCGA<br>GAGGTAGGGATCATAATGAAACAGAAAGAAGCTGGTTTGCATGTGCG<br>GATGCTCACACAAGAGATTCGCAAATCACTTGATAGGCATACTATTT<br>TGGACACGACCCTGGTCGAGCTGTCCAAGACACTGGGGTTGCAGAAC<br>TGTGCAGTTTGGATGCCTAACAATGGTAAAACCGAGATGAACTTGAC<br>GCATGAGAGGGGAAGGAATTACTCAGGAACCTATCACATCCCTATTC<br>CGATAACTGATCCAGATGTTGTTTCAATTAAGCAGAGCGATCAGGTG<br>CATATTTTGAGACCTGACTCAGAACTCGCAACTGCAAGTAGTGTAGG<br>GCCTGGGGAGTCCGGCCCAGTAGCCGCAATTCGGATGCCAATGCTTC<br>GTGTCTCCAACTTCAAGGGAGGGACCCCTGAACTCCATCCAGCATGT<br>TATGCGATACTGGTCCTGGTCCTTCCGGGTGGAGAGCCACGATCTTG<br>GAGCAATCAAGAACTCGAGATTATCAAGGTGGTGGCCGATCAGGTGG<br>CAGTGGCTCTCTCACATGCAGCAATCCTTGAAGAGTCTCAGTTAATG<br>AGAGAGAACTGGAGGAGCAAAACCGGGCTCTACAGCAGGAAAAGAGG<br>AACGCTATGATGGCAAGTCAGGCCCGAAGCTCATTCCAAAAGGTCAT<br>GAACGATGGGCTAAAGAGGCCTATGCACACGATCTCAGGGTTGCTCT<br>CGATTATGCAGGATGAGAGTTTGAATGCGGACCAAAAAATTATTGGA<br>AACGCAATGGCAAGAACCAGCGCCGTCTTGGCAAATTTGATAAATGA<br>TGTGGTGAACATGTCAACGAAGAATAGCGGGAGATTTCCATTGGAAG<br>TAAGATCATTTTCTATGCATGACATGATAAGAGAAGCAGCTTGCTTG<br>GCTAAGTGCTTGTGTATCTACAAGGGGTTCAGTTTTGAATTGGACAT<br>TGATAGGTCCTTGCCGAACAACGTAATGGGCGATGAAAGGAGGGTTT<br>TTCAGGTAATTCTGCATATGATCGGTAACTTGCTGAATGACAGTAAT<br>CAAGGGAAATTAGTTACCCTTCGAATTCTTCGTGAGAAAGCCAGTGG<br>AAGTCAGGGAAGGTATGATCGAGGTTGGGTGACGTGGAGGTCCGAAT<br>CAACTGATAGAGGTGTGCGTATCAAATTTGAAGTTGGAATAAGCGAC<br>GACATTTCTCTGTTGGAGAGGTCAGTTTCGACAATCCAGCTTGGAGG<br>TCGGAAATACAACAGTGATGGGGTTGAGGAGGACTTCAGCTTCAGCA<br>TCTGCAAATGGCTAGTACAGTTGATGCAAGGTAACATCTGGGTAGTC<br>CCGAACACTCAGGGCTTCGCTCAGAGCATGACACTTGTCCTACGGTT<br>CCCACTCCGAGAGTCCATCTCAGTGACCATTTCTGAACCGGGGCCAT<br>CTCCAGATTATACACTCTCCAACTCAGTCTTCACAGGCTTAAAAGTA<br>TTGCTCGTGGACTCTGACGATGCGAACAAGGCCGTCACCCGGAAGCT<br>TCTTGAGAAGCTAGGCTGCAAGGTGTCCACTGCCTCTTCGGGATTCG<br>AGTGCCTCGGCGCTCTCCGCCCCTCTGAATCTTCTTTCCAGATTGTC<br>CTTTTGGATCTTCACATGCCCAGCTTGGACGGGTTTGAAGTGGCAAA<br>TAAGATTCGCCAGTTCCACAGCAGTACCAATTGGCCAGTGATTGTCG<br>CCTTGACCACTAGCGGTGACGATATTTGGGAACGATGTTTGCAGGTC<br>GGAATCAACGGAGTTATCAGAAAACCAGTCCTCTTGCACGGAATGGC<br>CAACGAGCTTCGGAGAGTCCTGTTGCAGCCAAGCAAGACGCTGCTAT<br>GAAATGTGGATGAAGCTTCATTCCAAGATGTAATGCCTCAATGTCAA<br>TAACTTACCCTTCCTCCTTATTACCTACCAAGATTTTCAACATATAA<br>AAGTTGTCCTACACACAAAAGAAGGCTCAGTCACCATTAGAAATGTA<br>ACATACTAGTCCTTTTTCATGCCCTTGCTTTTTATGCATTTTGTAGT<br>GATCAGAGATCCTTTCTAGATTGCCATTTTGGCAAAACATGTCAGCT<br>CTTCGAGAAAACTAAATTATTGCTTGCTAGTTTTTAAACGATACATG<br>TATGCAACTCACATTTCAGTGAAATAGATATGAACTCTTGGCCCAAA<br>AAAAAAA |
| 78 | CTCGCCCTCTCCCTTTCTCTCTCTACCCTTCACTCTCTCTCTCTC<br>TCTCTCTAGAGAAAGAAGGAATTGAACGATAGCAATGGCGGGTTACA<br>GAGCCGAAGACGACTACGATTACCTGTACAAGGTGGTGCTGATCGGG<br>GACTCCGGGGTGGGCAAGTCCAACCTCCTCTCCCGCTTCACCAAGAA<br>CGAGTTCAACCTCGAGTCCAAGTCCACCATTGGCGTCGAGTTCGCCA<br>CCCGCACTCTCACTGTCGACGGCAAGGTCGTCAAGGCTCAGATTTGG |

TABLE 2-continued

Cell Signaling Gene Sequences

| SEQ ID NO | Sequence |
|---|---|
|  | GACACCGCCGGTCAAGAAAGGTACCGTGCCATCACTAGTGCTTACTA<br>TCGTGGAGCTGTAGGTGCACTCCTTGTGTATGATGTCACTCGCCATG<br>CAACATTTGAAAATGTGGATAGATGGCTGAAAGAATTAAGGAACCAC<br>ACAGATCCAAGCATTGTGGTGATGCTTGTTGCGAACAAGTCTGACCT<br>TCGTCATCTTATAGCAGTCTCAACAGAAGATGGGAAATCCTATGCTG<br>AGAGGGAATCGCTGTACTTCATGGAAACCTCTGCACTAGAGGCAACA<br>AATGTAGAAAATGCCTTTGCAGAAGTGCTAACGCAGATCTACCGTAC<br>CACTAGTAAGAAGACAGTGGAAGGAGATGATGGATCTGCTGCTGCGT<br>TCCCTTCTCAAGGAGAAAAGATAAATATCAAGGATGATGTCTCTGCT<br>TTGAAGAAAGTTGGCTGTTGCTCAACTTAAGGTTGGAGGTGATTGTT<br>GCTTGCATAGATTAATACTTTGATTTCAGTTGTATAACATTTTTCAT<br>GCCCAAAAGCTGAAGAAAGTTAGCTAGAAGAAACTTATGAGACACT<br>AAATTTGTGCAGCAAAAGCTTAGTACATCATGCCTTTGGCATGGCAG<br>TAGGATAGCTGCATAAGTTAGTTATTTCTCTGTTCTGATTCATGCAA<br>AGCCATTATTTAGGCAGTTTCATCTTTCTGAGAATTAACAAGATGTT<br>GCTTTAAAAAAAAAA |
| 79 | GCAACCAACCTCCTCCTCCACCTACGCCACCACTACCACCACCATCA<br>CCACGCAACGCACCGCGGCCGCGGCCGCCACCATGCAACCCTCTCAA<br>CCTCCTCCTCTCAATGAAAATTACTTGCGAGACGACGTCAAGTCGCA<br>AGAATGCGAAGACTTGCACTCCTCTCTCCCTTCGGAAGAAGACTGGG<br>TCCCCACCTCTCTCCCTTCGGAAGAGGACTGTGTCCCCTCCACTCTC<br>CGCTTGTACCAGGGCTTCTGGTTCCCCTCTTGGGTCTTGAACAGCGT<br>CGTCGCTTGCCAAAATCACTTCCAAGCTCACCCCTCCGACATCCTCC<br>TCGTCACCAGCCCGAAATGTGGCACCACCTGGCTAAAGGCCATCCTC<br>TTCGCTCTCTTGAACCGTGCCAAGTACTCTGACTCCAACTCACAAAA<br>ACGCCACCCTCTCCTAACCCAAAACCCCCACGACCTCGTGCCCTTCT<br>TGGAGTTCAGGCTCTATCTCCAGAATAAAAATCCTGATCTCACTGCT<br>TTTGCATCCCCGAGGCTCTTGGCCACCCACTTGCCTTATTCCTCTCT<br>TCCACGGTCGGTGAGGGACTCCAATTGCAAGCTGGTTTACTTATGTA<br>GGAACCCTAAAGACACTTTCATCTCGATGTGGCACTACTTCAACAAG<br>TTGAGGCCCGAAGAGAAGGGCCAGCTTCCACTCCCGGAGGGCCTCGA<br>CAAGTTCTGCCGAGGTGTGAACTGGTGTGGGCCTTATTGGGACCATG<br>TGCTGGGTTACCACAAGGCGAGCTCGGAGATGCCCGAGAAGGTTTTG<br>TTTGTGAAGTATGAGGAGATGAAAGCGGACCCGAGCGTTCAAGTGAG<br>GAGGTTGGCCGATTTCATGGGGCGTCCATTCAGCGAAGAAGAACTGA<br>GAAACGGGACCGTGGAGGGAATATTGAGGATGTGTAGCTTTGACAAT<br>TTGAGTGCACTGGAGGTGAATAGGAGCGGCAAGTTGCCATCTGGACT<br>AGAGAAGAAGTGGTTCTTCAGGAAAGGCGAGGTTGGAGATTGGGTGA<br>ATTACATGAGCGCTGAAATGGGAGAGCAAATTGACGGTGTCATGGAA<br>GAAAAGTTGCATGGTTCTGGTTTGAAGTTTTAGGACATATGACCCAC<br>TCGAAGATGTTTGGTTTGATGGTGGAAAAGAAAAATGTGTGTAAAAA<br>GAAGAAAAAAGAAGCAAAAACGATTCGACTCTCCGCACTTTAGGGGG<br>TCAATGTCTGGATGAAAGATCTTCAGTGGCATTGTCAGTCCTGGTTT<br>CGTCTCCATAGTGAGATGCTTTAAGGTTGTGATTCTAGTCTTCATCT<br>GTGTTTTGTACTATTGGCGTTTGGCAGAAGTTATTTGGCCAGTACGT<br>AGCTGGCTAAACAAGAGCTGCCTAGCTGCTCCCTGGGAGCTTGTGGA<br>TGTATCTTCTGTTATTTATTTCAATTCCATTTTTCTTTTTCAAAAAA<br>AAAA |
| 80 | GTTCGCCGAGCATCATCGAAGCGACCGTCCGTCCTCCCCTCCCCTCC<br>CGATCGCGCATGAGGTTTCCTCCTAGATCCGGCTGATCGACTAGGGG<br>GGCGATGGCGATTCTGTACGCGGTGGTCGCCCGGGGCACCGTCGTCC<br>TGGCGGAGTTCAGCGCCGTCACCGGCAACACCGGCGCGGTGGCGCGC<br>CGGATCCTCGAGAAGCTCCCCTCGGAGGCGGACTCCAGGCTCTGCTT<br>CTCGCAGGACCGCTACATCTTCCACATCCTGAGATCCGACGGCCTCA<br>GCTTCCTGTGCATGGCCAACGACACCTTCGGAAGGAGGATTCCTTTT<br>TCATACTTGGAAGATATTCAGATGAGATTCATGAAAAATTATGGCAA<br>AGTTGCACACTTTGCACCTGCATATGCCATGAATGATGAGTTTTCAA<br>GGGTTCTGCATCAGCAAATGGAATTCTTCTCTAGTAACCCCAGTGCA<br>GACACTCTGAATCGGGTCCGAGGCGAAGTTAGCGAGATGCGAACTAT<br>AATGGTGGATAACATCGAGAAGATACTGGACAGAGGTGATCGAATTG<br>AGCTACTTGTTGACAAGACTGCTACAATGCAAGATGGTGCCTTTCAC<br>TTCAAGAAACAGTCCAAGCGCCTTCGTCGAGCTTTGTGGATGAAAAA<br>TGCAAAGCTTTTGGCACTGTTAACATGCTTGATTCTTGTGCTGCTTT<br>ACATTATTATTGCTGCTTGTTGTGGAGGCATCACTTTACCCAACTGC<br>AGATCTTAACCTCTATAGTTGCTGGTGTTGATCTCCGGTAAGTATAT<br>ATGCCATGGGTGATATTTGGGTCACATTCAGGGTCCTATTTGTAACT<br>TGAGAAGCGCTCAAATGGAATTATGATGCGCCACTGTCTGCTAAATA<br>TCACCCTGTTGGGAGGTGCTATTCTGGTTTTTGGGGAGTCTGATGGG<br>GTCCATCGCTTCCATTTTCTTGATGAGTTTGTTGTGTATTTTCACGG<br>GGCATCTCTACACTGATGTAAATAATGTACTTATTTATAGCTGACAG<br>TCGAGCTTTTGCCAAAAAAAAAA |

TABLE 2-continued

Cell Signaling Gene Sequences

| SEQ ID NO | Sequence |
|---|---|
| 81 | GGCAAAGTTTAGGAGAAGAATATGACAGGAACCATGATCGGAGTCAC<br>CAACGCCAATGAACAACAAGCCCTCGACAGAGCCCAAGAGGTCCGAC<br>AATTTGAAGACTCCAACCTTGGAGTCAAAGGCCTCCTTGACTCGGGC<br>CTCTCCACCCTCCCTCCCATGTTCATCCACCCGCCCGACCTTCTATC<br>CAGCCTCAAGCCTGTGGTTGGGCTCAAGACCGATTCAATCCCCATCA<br>TTGATCTCTCCGGCTCCAACTCCGACCGACGACCCTCAGTCATCGAG<br>GAAGTTGCACGTGCTGCTCGTGAGTTTGGCTTCTTCCAGATAGTCAA<br>TCATGGCGTGCCCACGGAGGTCCTGGGTCAAACGATCGCGGCAGTGA<br>AAGCGTTCCATGAGCAGCCAGCGGAGGTGAAGGCTAGGATCTATCGA<br>AGGGAATCTGAGACCGGGGTCGCCTTCTTCGCCTCCAGCGTGGACTT<br>GCTTCACTCCAACGTGGCTTGCTGGAGGTAATGTGAATGTCAATTTC<br>TATGTTGGGTCGACAAGACAGGAACATTAGTGACTCGAAATTAAGAA<br>AATTACCAAAAAAGGTCTTAAATATGTTGCATGGGAGGCTAATTCAA<br>TTTTAAACATTTTTGACAGTTTGCAATATAGTCATTCAAGCTAATTT<br>TGGCAAGAAATTATTAAAGTGGACATCGTTTGTTTTATGTGACACAC<br>CTGACACTAATATTCGTAATTTTTGTATTTTTTAACTTCTTTTTTT<br>TTAATTTTTTTTTTACGTCGGCCATGCCATGTAAAATTGCTTACATC<br>CATGGCAACGAAGTTCTATCAAAATTTTATATTATCAAATGGTTAAA<br>AGATTTCAAATTAAATTAATCAAATTGAAATAGCAAAAAAGCCACCA<br>AAAATTCCAAATTTTACTCATTGTGACAAATATACCTCAAACTTTTT<br>TTGTGAGATAAAATACCCCAACTTTACCAATTGTGACACATTTAACC<br>CAAACTTTTTTGACACAAAAGTCCCAAATTTATACATGCATGACACA<br>TTTACCCCAAACTATAAGGTATTTTCGTTTTTTACTTTTTAAATTTT<br>TTTTCTCTTTATTTTTCTGCTTTCTTCTCCTTTCTTCCCTCCGCTGG<br>CATGGTGGAGAGAAGCCGGACTCAGGCGAGGATCCTTAGGTCGGGCG<br>AGGATATCCCTCACTAGATTCGGCAAGGGCAACCCTCGCCTCACCCA<br>AGCGAGGGCTGCCCGAGCTAATGCCAAAGAGGCACTCACCGGATTTG<br>GCCCAAGCGAGGACCACCCTCACCCGCCCAAGTGAGGGTGACCCTTG<br>CCCGATGCCAGTGAGAGCGGTCCTCGCCTGAGTCCAGCTTCCCTCCA<br>CTAGCCACGGCGAAGGGAAGAAAGAAGAAGAAAGAGGAAAAAAATT<br>AAAAAAAAAAAAACGAAAAATGCCCTTCAACCATGGAGTTGGGGTA<br>AATGTGTTACAGTTGATAAAGTCTGGGATTTTTTGTGTCACAAAAAA<br>ATTTAGGGTAAATTTATCATATTTGGTAAAGTTTGGGGTTTTTTGTG<br>GCATTTTCCCATTAAAATATTTAGAACCGAATTGATTTTTGTACTAT<br>ATATATATATATATATATATATATGACTTTTTCAGTAATTATCAT<br>CTTGAATTGATGTGAATATTAAATTGTCCTTTTGTATAATCGAAATT<br>TTCATTGTCCCAAAAGAAGTTTCATACACACACATATTTGCAAATTA<br>TATGAATTTATCAGTGACAATACAATGAATGGGACGAAGTACTAATG<br>CGCACCAATTTATCAGTGACAATACAATGACGGGCACAGAGTATTA<br>ACGTGCACGAATTTATTTGGTCTTTTTCTTAACCATAAACATCTTAA<br>ACATTTACACTATATAAATTAGGACACTTGAGTTCATATAATTTTCA<br>TACTTTTTAAAAATCTATATAATATATTAAATTTGAACAAGCGAGAA<br>GAAATGTTCCTCGGTGATATACAAGAAGCACAAACAATGTGCAAAAA<br>GCAAATAGAAAGAGTGTTTGCGTTTTTTTCTTAATTAAGGTGAAGAA<br>TAAGAAGAAATTAGTTCAGTGCACGAAGTAAATATTACAGGGATTCG<br>CTCCGGATAAGGTCGGGTCCTGTACTCCCAGACGAGGAAGAAATACC<br>GGAGGTGTGCAGAAATGAGGTGATGGAGTGGAATCAACAGACCCAAC<br>ACCTCGGAGTCCTCCTGATGGGTCTGTTGAGCGAGGGGTTAGGATTG<br>AGTCCGAGCAAGCTCCAGGACATGACGTGCGTGGAGAAGCGAAACAT<br>GTTGGGGCATTACTATCCTTACTGTCCCCAGCCTGATCTGACTGTTG<br>GCCTGAAGCCCCACACCGACAAGGGGTGATCACGGTGCTCCTGCAA<br>GACCAGGTTGGCGGGTTGCAGGTGAAGCACGGCGAGGCGTGGCTGGA<br>TGTGACGCCCTCTCCAGGTGTTCTCATTGTGAACATCGGCGACCTTC<br>TCCAGATCATGTCCAATGACGAGTACAAAAGTGTGGAGCACCGAGTG<br>TTGGCCAATCCAGGCCCTGAACCACGCCTGTCGGTAGCGGTTTTCTA<br>CTATCCGCTTGAATGCGAAAACCAGATCGGACCGATCCCAGAGCTCG<br>TGTCACCAGAGAAACCTGCTGCTTTTCGACAATTCAAGCTTGGCGAG<br>TACCTGAAGAGATTCCAAACTGAGGTGCTGGATGGGAAAACTTTGAA<br>AAATCACTTCAAGACATGATATAAGAGGCATCTAGGCTAATATAGAT<br>GGTGCAAGAATAAGATGCTTCCTTATTTTTAATAAGAAGCAATCGCT<br>TATTAAGTTGTAAGTTCGGTTTGGATTCGCTAGAATTCCAAAGCCAT<br>TGTCCTAGTTCAAGGACGCTGTGTGCCTATATTTAAGAACGAGTCAT<br>CTCGTTTCCTCCACAATAAGTCGGTATGTCTGGTAACAGGACATAT<br>ACTACTTCCTCATCCTATTTTAACTGCACTTCTCATCGAAATTGTCT<br>GTCCTATAACTCTCTTAC |
| 82 | CCGCCTTTAATATATAAATATCGTCCCCTCCCTCTCCCTCTCCCTCT<br>CGTGTCCAAGTAAAAGGAAAAAGAAAAGAGACAGAAAACAGAAAAGC<br>GGCGGCGATGGTGGTGGCGAGTCCGAACCCACGACGGGCCGAGAAGA<br>TCCAGGCCGTCGAGCTCCCGGCTCGATCGACCTCTCGCCGTCGGGGAGA<br>TCCGCGGCGCCGCGGCTCATCGTGGAGGCCTGCGAGAGGTACGGCTT<br>CTTCAAGGCGGTCAACCACGGCGTCCCCGCCGAGATCGTGTCGAGAA |

TABLE 2-continued

Cell Signaling Gene Sequences

| SEQ ID NO | Sequence |
|---|---|
| | TGGACGAGGCGAGCGCCGGCTTCTTCGCGCGGCCCGCCTCCGAGAAG<br>CGGCTCGCCGGGCCCGCCGACCCGTTCGGGTACGGGAGCAAGAGCAT<br>CGGGTTCAACGGCGACGTCGGCGAGGTCGAGTACCTCCTCCTCGAGT<br>CCGACCCCGCCTTCGTCTCCCGCAGGTCCGCCAGCATCTCCGACGAC<br>CCCACCCGGTTCAGCGCTGCTGTGAATGTCTACATAGAAGCAGTCAA<br>GGACCTGGCCTGTGACATATTGGATCTTATGGCCGAGGGCCTGGGGG<br>TCCGGGACACGTCGGTTTTCAGCAGGCTCATCAGGGCCGTCGACGGC<br>GACTCGGTCTTCCGGATCAACCACTACCCCCAGTGCGCGGTCCTTCA<br>CGGCGAGGTCGGGTTCGGGGAGCACTCCGACCCTCAAATCCTGACCG<br>TCCTCCGATCCAACAATGTGGGCGGCCTCCAGATCTCACTCGAAGAC<br>GGGGTGTGGACCCCGGTGCCCCCAGACCCCGCAGCTTTCTGGATCAA<br>TGTGGGCGATCTTTTGCAGGCCATGACGAACGGGAGGTTCTCGAGCG<br>TGCGGCATAGGGCGGTGACCAACCCCTTCAGGTCCAGAACGTCGATA<br>GCGTTCTTCGGGGCGCCTCCGCTGGACGCGCGGATCGCTCCCCAGCG<br>GGAGCTCGTCACTCCTCGAAGGCCCCGTCTCTACAACCCCTTCACCT<br>GGGCCGAGTACAAGAAAGCCGCCTACTCCCTCAGGCTCGGGGACAAG<br>CGTCTCGACCTCTTCAAGGCCTGCAGAGAAGACGGCGGCATCGATCT<br>GTGAGCAGATGGAGGAGATGGGTCGTCTCTTTTCTGCCCTTTTCTCT<br>CTCTCTTGTTGCTGGGCCTGTCGTGAAGGGAATTTTGGGTTTGCGTG<br>TTCTGCTCCCCTTCCTCTGTTTTTAGCAGCAAAGAGAAGCTCTCCTA<br>GTGTTGGTGTACTGTTGTAATCAATGGAAAGGTATGTTAGGCGACGA<br>TATTATGTTTTGGCTTTTATCTATCAATCGACCCATCGGTTGATTTT<br>ATCTAAAAAAAAAA |
| 83 | GTCCAGATTGCTCTCGACATGTACAGAATACAAGCAGGGTCGGCAGC<br>AGCGGCAGGGGTCGAGCCTGGATACTGTGTTGAGACCGATCCCACCG<br>GTCGGTATGCTCGGTTTGAAGAAATTCTGGGCAAAGGGGCGACCAAG<br>ACAGTTTACAAGGCGATCGATGAGGTCCTGGGAATGGAGGTGGCGTG<br>GAACCAAGTGAAGCTGAATGATTCGTTTCGGTCTCCGGACGAATATC<br>AGCGTCTGATCTCGGAGGTTCACCTCCTCAGCACCCTCAATCACGAC<br>TCCATAATGAAATTCCACACTTCATGGGTCGACGTGGATGGGACGGC<br>CTTCAATTTCATCACCGAAATGTTCACTTCAGGCACCCTCAGAAATT<br>ACAGGAAGAAATACCCACGATTGCACATCCGAGCCATAAAGAATTGG<br>GCTGTTCAAATACTTCACGGCCTCGTGTATCTGCACAGCCACGATCC<br>GCCAGTAATCCACAGAGATCTGAAGTGTGATAACCTCTTTGTTAATG<br>GACATCTGGGACAAGTTAAAATTGGTGATCTTGGACTTGCAGCGATC<br>CTTCATGGTTCTCGAGCAGCTCATAGCATCATAGGCACTCCAGAGTT<br>TATGGCACCAGAACTCTACGACGAGAATTACAATGAGCTGGTCGATG<br>TCTACTCATTCGGCATGTGTGTCTTGGAAATGCTTACTTGCGAGTAT<br>CCTTACATTGAATGCACCAATCCGGCTCAAATTTACAAGAAAGTCAC<br>GTCGGGAAAGTTGCCAGAAGCATTCTACCGTATCAAAGACTCAAAAG<br>CTCGGAAATTTATTGGAAAATGCTTAGCAAACGTCTCATGTAGAGTA<br>TCGGCAAGGGAGTTGCTACACGACCCATTTCTTCTAAGTGATGAAGG<br>TGACCGCCTCCCAGGATTGAAGTTCAAAATGCCGGAGCCATTCTTGA<br>ATGGGAGAGATGTAGATAATCTGCGTGCAAGGGATAATCCACTCAGG<br>ACCGACATGATGATTACGGGAAAGTTGAATCCTGAGGGTGACACCAT<br>TTTTCTGAAAGTTCAGATTGCTGATAGAAATGGTTTGAATCCCAAGT<br>ATCTTCCTGCAATCCATTAGAACTATTGAGAGCACAGAATCACTGTA<br>CACAATTTCTCTGATGCATCAGTACTAAGTTTTGTAAATTAGTTAAG<br>AAGAAAGCATGCAGATTGTGGATTATTATCCGGTACCATTTGCAAAA<br>AATCGATGCCTCAAACTAGTTATATATTGCCCTAAATAGAAGTTGAA<br>GGGGAAAATGGCTGAACGCATATAATTCTCAGAACTCGTTAAATTAG<br>AGACTATAGAAATTTCTGGCCAGACTTATCTTCACAGATCTTCCAGA<br>GTGATGAAACTAATGAAGGTTGTCTTCATTTCCTTCCCATTACCCAT<br>GCAGGTTCAGCGAGAAATGTCTATTTTCCTTTTGACGTTCTAAATGA<br>CACTCCGATTGATGTCGCAAAGGAAATGGTCAAGGAACTGGAGATCA<br>TGGACTGGGAAGCGGAGGAGATAGCCGACATGATTGGTGGAGAAATC<br>TCTGCTTTAGTACCCTAACTGGACGAAACAGGACATGACAGACTACAA<br>TCAGGAAAATGACGACGGCTTTGCTCCACCTTTTCTCTCATTCTCTT<br>CAGGTTCGTCATCACAGGCATCGCCATCGGGCTTTACGGCCTACAGG<br>GAAAATGAAATCGCGTCTGACTACGGTTGTCTCCAGGATGTGCCAGA<br>TGATATGAGCTCTCCAAGCTCCATACATTCTGGCACATATTCCCACA<br>CAAGTTACTTCTGCCCGGAAGATCAAGAAGTGAACCCCGGTCCTTCA<br>AACCCAGATCAACACCTTATCAGCAGAAGCAACAGACATACGAGGTT<br>TTGCGCCGACGACTACCAAAGGCCAAGGCAATTCAAGGATAGGAGTC<br>AGACCTTGCAATGCCAGGTCCTGACAGGGTCAGATAGAGATTCTTCC<br>TCCGTCATTAACCGGAGGATGGCCGGCCACAGACTTTCACGGAATAG<br>GTCTCTGGTAGATGTTCATAGCCAGTTACTTCACCTCTCATTGCTGG<br>AGGAGGTGAGCAAGCGGAGGCTGTCCAGGACAGTCGGAGAAGTTGAG<br>AACATCGGGTTTCAGGCACCCTTTGAGATATCAAGAAACGCCCCCTG<br>GATTGGCGGATCTAGTTTCATCAGCAGCTCGAGGAATAAAAAGGGCC<br>ACAGGATTCAAAACAGAAGAAACTGAAATCTGCCCTCTCTCATGAGC<br>ATCTAAAGATGGTAATTTGTATCAAAATGTCAGCAATTTAGGACTGT |

TABLE 2-continued

Cell Signaling Gene Sequences

| SEQ ID NO | Sequence |
|---|---|
| | ATCCACCCTGCAAAAGATCAAAAGTATTAGCCTTGTAGCTTAAATAA GTTTCAAAAAAAAAA |
| 84 | TGTCAGTCTCCCTGTCCCCGCCTCTCCGTCTCATCATCCTCCTCCTC GTCCCTCGTCATCGCTTTCCTCCATCAAATCAGCGTCTCCCTCCCTC CCTCGCTCACTGTGATCCCAGACCAGCGCCGGCTGCTCCCGGGCTCG AAATCTCCGGCGACGTCGCCCGCCCGCCGACCGACCGACCGACCGAG CTCGCCGGAGCCATGGACGCCGGCTACCTGTTCAAGGAGGAGACCTC CCTGTACAACCGCATTGTCCTCGGCAGCCTCCTGCCGGCCTCGGCCT GGGAGCCGATGCCCCGGTTACTCCAGACCTGGCTCCGCAACTACATC GGCGGAACCCTAATTTACTTCCTCTCCGGCTTCCTCTGGTGCTTCTA CATTTATTACCTCAAGCGCAATGTTTACGTCCCGAAGGATGAGATTC CTACGAGGAAGGCAATGTTGCTGCAAATATATGTTGCAATGAAGGCA ATGCCATGGTACTGTGCTCTTCCAACACTTTCCGAATACATGGTTGA AAATGGATGGACGAAATGCTTTTCAAGAATAAGCGATGTTGGTTGGC TTGCTTACCTAGTGTACTTGTCAATATATCTTGTAATGGCGGAGTTT GGGATATATTGGATGCACAGAGAGCTGCATGACATTAAACCCCTTTA CAAGCATCTTCATGCAACACATCACATCTACAATAAGCAGAACACAC TTTCTCCTTTTGCCGGCTTGGCGTTTCATCCTCTAGACGGGATACTG CAGGCGGTGCCACATGTTATGGCACTATTCCTTGTGCCAACCCATTT TACAACGCACATTGCTCTCCTTTTTCTCGAGGCCATATGGACAGCAA ATATCCATGACTGCATCCATGGTAAGCTTTGGCCTGTGATGGGCGCT GGTTATCACACCATCCACCATACCACCTATCGCCACAATTATGGTCA CTACACCATCTGGATGGACTGGATGTTTGGAACACTCCGAGACCCCA TAGATGATGGATCCAAGAAGGAGATGTAATTTATGAAGGGTTTCGTG CCAATTGTTGTCCAAATTCTTATTTGACTTGGGTACTTGAATTTTTA TTTGCGTTGCTTCTTAATCGTAGTACTTGCTTGTAAATGTTGGTCCC TATTGAGATTGTTCAGCATCCTGGACTAGCAAAGACTTTTAAAGTAG AAGAGGAGATTTATACTACAAAAAAAAAA |
| 85 | AAAACAATGAAAAACCCACACTCGCTAGCAAGGGAAAGGTAAGTGCT TCACTTTCATGTGCTTGTTTCGATTCGTACTCAAAACAACAAGCCTA GCGGTTCCACCACCATGGCACACCAGCAACTTTGTTCGCAGTCCGCC ATAGCAGGTACTGAAGAGCATGAGCGGAAGGAGACTGATGAACTCAT TGCTTCACTTCCCCAAAGGAAAGGCGCGGTTCGTCCTTTCCAGTGCC TTTACCAAAACTTTTGGAGCCCCATCTTCGTGCTTCCCAACGTGATC ACGTTTCAACGGCACTTTGAAGCCAAACACAAGGATATTGTTCTGGC CTCTCAGCCCAAATCAGGGACCACCTGGCTAAAGGCCCTAGTGTTTT CCATCGTTAACCGCTTCCGCTTCGGCATCTCCAACACGCCCTTGCTC ACTTCAAACCCCCATGAACTCGTTCCATTCTTCGAGTTCCAGCTGTA CGGAAGTAAACTGAGGCCCAACCTTGATGGCCTGGCAGAGCCGAGGC TCTTCGCAACGCACATCCCTTATCCATCCTTGCCGGAGTGCATCAAG CGGTCTGAATGCCAAATCATTTACATTTGCCGGAACCCGTTGGACAC CGTGGTTTCCTCTTGGCACTTCTTCCTTGAGAAGGCGCGATTAGAAG ACCAGCCAGAGTGGTCATTGGAAGAGCATTTCGAGACCTATTGCCAA GGGACAATCTCGTTCGGGCCCTTTTGGGATCACATCATGGGGTATTG GAAGATGAGCTTGGAGTGGCCATCCAAGGTGTTGTTCCTCAAGTATG AGGACCTGAAGGAGGATACTGTAGTACACCTGAATAGGGTGGCCGAG TTTGTGGGTCTTCCCTTTACTGAGGAGGAAGAGGAGGCAGGTGTGAT TGAAGAGATAGCCAAAATGTGTAGCTTGAAGACCCTAAAGGACCTAG AGGTCAACAAATCCGGCAAAGTAGCCTTGACGATCGAGTTCGAGAAG AGAAGCTTTTTAGGAAAGGGGAGGTGGGTGATTGGGTTAACCATCT CACTCCTTCCATGGTGGATCGCCTCAATAGCATCATCCAAGAAAAGA TGAGCCCCTTTGGGTTGGAATTCAAAACGTGTTGAGCGTTAAATACT TTCACTTTCTCTACTTGTGTCACTAGAAATAAGTGAAATTAATAATG GATCTGCAATCTTCCTTATTGATGTAGTATAGAGAACTTAAGAATCC TTGACTTCTCTGTCGCAAGAGAAGAAACAAGTATTTGAAGCTGGTCA GGTGTGAAGAAAAAAAGGAAGCATTGGTAGCATCGGTAGACTACAT CTATGCTGTAAACTATTCCTATCCTATAATAGTTGCATGTATTGTCT ACGTGTTCAGTTCAATTAGAGATCATGTATTCACAAATTTACTATTAA TTCATCAACTTTTCAAAAAAAAAA |
| 86 | CTCTCGTACCCCCCACCACCAACCATGCCTGAATCCCGTGAAGACTC TGTCTACCTCGCCAAGCTCGCTGAGCAGGCTGAGCGTTACGAAGAAA TGGTCGAGAACATGAAGCGCGTCGCCTCGTCCGACCAGGAGCTCACC GTCGAAGAGCGCAATCTCCTTTCCGTCGCATACAAGAACGTCATCGG CGCCCGCCGTGCATCGTGGAGAATAGTATCCTCCATCGAGCAGAAGG AGGAGTCGAAGGGCAATGAGGCCCAGGTCTCCATGATCAAGGGCTAC AGGGAGAAGATCGAGCAGGAGCTTGCGAAAATCTGCGAGGACATCCT CGAGGTGCTCGACAAGCACCTGATCCCCTCTGCGGCCTCGGGCGAGT CCAAGGTCTTCTACCACAAGATGATGGGCGACTACCACCGCTACCTT GCCGAATTCGCAACCGGCGATAAGCGGAAGGACAGCGCTGACAAGTC GCTTGAGGCCTACAAGGCCGCATCTGACGTCGCCGTCACCGAGCTCC |

TABLE 2-continued

Cell Signaling Gene Sequences

| SEQ ID NO | Sequence |
|---|---|
| | CCCCGACACACCCCATCCGTCTTGGTCTCGCCCTGAACTTCTCCGTG<br>TTCTACTACGAAATCCTCAACTCGCCCGACCGTGCATGCCACCTCGC<br>AAAGCAAGCATTCGACGACGCCATCGCCGAGCTCGACACGTTATCAG<br>AAGAGAGCTACAAAGACTCGACCCTGATCATGCAACTGCTCCGGGAT<br>AACCTGACGCTCTGGACCTCGGACATGCAAGACTCTGCTGACAAGCC<br>CGCCGACACAAAGGAGGAGGCTGGGGATGCACCGGCAGAGGATTAGA<br>TATTGCACGCGCTCGTTTCTTGTTACCCCTCACTTCATGCCATGCTA<br>CATCCCCCCCTTCCGTACACGTCCTCCAATCCAATGTTATTTCTTAT<br>TAGCGCTAAGACCTTACCTCTGGATCCCTTCGTTGAAAATAATGAAT<br>CCCTTTCTGCTCTATAAAAAAAAAA |
| 87 | AGCGTAGTTCTTTCCCGCAGCTCTCTACTTCGCTCTTCTTCTCAACC<br>CCTGAAGCCACCATGAGTTCCTCCTCCTCCGGCGGCGACGGCGGCGG<br>CGGCCCGAAGCTCCCTCACGACGTCGCCGTCGACATCCTGAAGCGGT<br>TGCCGGCGAGATCCCTCCTCCGATTTAGGTGCGTCTGCCGATCGTGG<br>CGTTCCGCCATCGACGACCCTCGTTTCGTGGCCCTCCACTTGAGCCA<br>CTCCGCCCTCCACGCCTCCAGTCGGCATCTCGCGTGTCTAGATTGCG<br>GCGAAGACGCCGTCCAGAACCGGTGCTCTCTGTTCCCCAACGCCCCT<br>CTCGCCCTGCCTCCTCCCCCGTTGCAAATCGAAATCCCGTTCGTTGC<br>TCCTCCCAACCGTTACGCCCTCGTCGGTTCGTGTAACGGTTTGATCT<br>GCGTCTCGGAGAGTTCCAGTGACGGCACTGAGCGGGCGCTGTATTTT<br>TGGAATCTATTCACCAGGAAGCATAAGGCGGTTCGGCTCCCCGTCC<br>GGAGCGGATGCCACCCCTCTCCGTGGGGGGCGCTCATGTAGTTCTAG<br>GGTTTTGTTTCGATGCGAAGTCTAATGACTATCGTGTTGTCAGGATT<br>ATCCGATACCTAGGTATTCGCCGTCGACGCTTCCGCAACAAGAAGCC<br>TCGAGTCGAGGTTTATTCGTTCCGTACAGATTCATGGAAGACCTTGG<br>AATGTGAGGTTCCTCTTCTCTGTGACAGTGCGGTCTTCTTGAATGGG<br>AACCTGCACTGGTATTCTTTCAATGGAGAGGGGGATGGATACGGATC<br>CATAGTCTTGTTCAATGTCGCAGATGAGGTGTTTGATGAAATAGCTC<br>TGCCGGAAGGGATCAGTCCCCATTTTGTGTTGTCCGTGGCGGTATTG<br>AATGACTCGCTGGCTGTGTTCTTTAGTGATGGGGAGGCTTGTTTCGT<br>TTGGGTTATGAAAGACTACGGCGTGCCAGAGTCTTGGAGTAAGCTGT<br>ATACTTTCGAGGTTACTGGACCGGTAACAGCATTTGATGGCTTTACA<br>TGGAATGGCGAGCTTCTTATGGAAATAAATTGCGAAGAACGAGTTTC<br>TTGGAATCCGATCACAGCACAACTCTCAATTCTTCCATTATTGGCGA<br>GATACGAATTGCTCCCCGTTGTAGAGAGCCTCGTTCCACCTTAGATA<br>TGACTCGATTGCTGCTATATCGTCAGGTGCAAGGTGCTGGAGCTCTT<br>CTTTATTAACAGGAATTCTGGTGATTGGCAATGCAAGTACAGCTGGC<br>TCTAACAAAAATGGGGAGTGGCAAAGGACAGCAGAAAGTGATGTTG<br>AAGTTTCTTCGGAATATAGTTTACGTGGAAGGCAAGAAACAATCTGC<br>TTCATGGTTAAGCTACTTCTCCCTTCGAGCATGTTCTTAGATTGATC<br>GATTTGAAGGCTATCTACTTTCAAAAGGATACATGTTGTGCTTATGA<br>TTATCTATATAATGTAATGATGGGGATAGTGAAAAGCTAAAATGTGT<br>GAGATTTGCTTAAAAAAAAAA |
| 88 | AAGCAGGCTGCGAGAATTTCGAAGTGCTGTCTGCTCACATCTCTCTC<br>TCTCTCTCTCTCTTCTGCGAGGCAGTGCGATGCCGTCCCGCCGGAGA<br>ACGCTCCTCAAGGTCATCATCCTCGGGGACAGCGGGGTCGGGAAGAC<br>CTCTTTGATGAACCAATATGTAAATAAAAAGTTCAGTAACCAGTATA<br>AAGCAACTATTGGAGCTGATTTCTTGACCAAGGAAGTTCAGCTCGAC<br>GATAGGCTCTTCACTTTACAGATTTGGGATACAGCTGGTCAAGAGAG<br>ATTCCAGAGTCTTGGAGTGGCTTTCTATCGGGGTGCTGACTGCTGTG<br>TTCTTGTGTATGATGTTAATGTTATGAAGTCATTTGACAATCTTAAA<br>CAATTGGAGAGAGGAGTTCCTCATCCAGGCAAGTCCATCAGATCCGG<br>AGAATTTCCCATTTGTGGTCATAGGAAACAAAATCGATGTGGATGGT<br>GGAAACAGCAGAGTGGTATCAGAGAAAAAAGCTCGAGCTTGGTGTGC<br>TTCAAAGGGAATATACCATATTTTGAGACCTCTGCGAAGGAAGGTG<br>TCAACGTGGAGGAAGCTTTTCAGTGCATAGCTAAGAATGCGTTGAAA<br>AGTGGTGAAGAAGAAGAGATATACTTGCCAGACACCATCGACGTTGC<br>AAACAGCAGTCAGCCAAGGCCATCAGGATGCGAGTGTTAAGAACTGC<br>CCGATGCTTCTTCCCAATAAATGAATCCATGAAGGATTACTCAGATA<br>TTAGCAGGTTCTGCTTGTTTTAGATGATGCTGGGTTGTACATTGCTT<br>TTGCCAGAGAAAATGGTTGCTGACAGATTCTTTTGTCTGGTTCCTTC<br>CATTTATTGCCGAATCAAAATGCATTCTTGAGTGATGTCCTACTTAA<br>TTTGTCTTTCATGACGCGGCTTTTCTCATCAGTGTTGATTTTTGTTG<br>GTGTAAAAAAAAAAAAAAAA |
| 89 | GTGAAGACGAAGGAGGAGAAAAGGTGAGAAGGAGACATAAGGAGAAG<br>AAGAAAAGGTGAAGGAGGAGGAGAAAAGGTGAAGAAGGAGAAGGAGA<br>AGGAGAAGGAGAAAAGTTGGTCTCGAGCTGTAAGGGGGTGAGGTTTT<br>TGAATGGATCATCGAGATAGTGGACCTGATTGCTGGTGAAGTCGCTG<br>CTCCAGTTCAGGTGTGTTTCCAAACAGTGGTGTTGCTCGATAGACAG<br>CCCTTGCTTCGTGATGGCGCACCTGAATCAGTTCGTCGGGCGGACTG |

TABLE 2-continued

Cell Signaling Gene Sequences

| SEQ ID NO | Sequence |
|---|---|
|  | CAAACCTCTGCCTCTGCGTCCAGCAAAATTCGAGACTACCGTATCTA<br>TCTGGGGTACCCAGCGTGGAGGATTTGAAGTACCGTCTCATGGGTCC<br>CAGCGATCAGATCCGCGTGCTGGGGTCTTGTGGCCGGCTTTGCATCA<br>TCGACGTGGCCGACGAGATCAATGTATGGGATCCGTCCACTAGGCAA<br>AGTATGCCATTGCCTCACTCAGCTGTCGAGATAAGGCGTCCATCGGC<br>TTTGCCTATTTGCGTTTATGGATTTGGGTGTGACGTTAGGAATGGTG<br>CTTTCAAGTTGTTGAGGCTGATTCAGCTCGCTACTGGGCAGAGAAGA<br>TCCGAAGTCAGTATCTATAATATGATAGATCAAAACTGGAGGCGGCT<br>CCCCGGAGATCGCTTACAATCTGGTTTATCCGGACAAAATGGGGGTTT<br>TCGCGTACGGCCGTCTGCATTTAACAGTGACTCCGGAGCGGTTGGCA<br>TGTTCCCCAGCAAAATTGCTGTTGGCTTTTGATTGTCACACTGAGGA<br>ATTTGAGGAGGTGGAGCTGCCTGATAATATAGATAAAAAGCGTGACA<br>TGGTTGTGGCCGTCCTGGACGGGCGCCTTTGCCTCAGCATTGATAGA<br>ATTGACATGTTTGCCGATGTGTGGATTCTGAGAGTATATGGATCCCA<br>AGAATCATGGGCTTGGGTGTTCTCGATACCTAAATATGATGATGATA<br>GGATTCCTCGATTTGTCTGGCCATTGGCTTGCTCCGAGGATCATCAT<br>CACGTTTTGGTGAGAAAGGACAATAAGGATGTCGTTTGGTATGATTT<br>ACATGCTAGGTACATCAATAGGGTAGATATAAGGGGCATGCCAAGTT<br>CCTTTAAAGATGCATATGTGATGTGATTCACTTGATCGGAGGAATCG<br>TCGAGAAGCAGCAAGAATTGAAAGAGGAAAATAGGGACCACAGGAAA<br>GTACTCCGTGAATAGTAGGTTCTTTTCTTTTGGACTGTCTCAGATTC<br>TTCATAGTTAGCTCTTTTCTTTTGGACTGTCTCAGGTTCTCTTCTGG<br>GAAGTGGTTCTGTAATATATATATTTGAGCAAAGAATAGATGAGATG<br>ATTGAGAACTAAAAAAAAAA |
| 90 | TCAATAGAATCAACAGATATGTAAGCCAGGTTACTTCACTCGTCCAG<br>AATATATAAGAGTGAGCAAGCTTTCAAGAAACAGAAAGCACATACGA<br>TTGAATACACCAATGGGAGCGTGGTTGGGTTGTATTCTGGGGCTCAT<br>CCCACTTCTAGGCTGCTGCTTGTGGTGGTGGAATGAGATTCGGTACG<br>TGTGGCCAGTAAAGCGAAGATGTTCGGGCACCAATGCGAAGTTGCCG<br>CCGGGACACATGGGATTTCCCTTCTTTGGAGAACTTTTCACCTTCCT<br>CTGGTACTACAAGATTCTCCGCCGCCCGGACGAGTTCATAAACTCTA<br>AAAGAAAGAAGTATGGTGATGGAGTAGGGATGTACAGGACTCACCTC<br>TTCGGATCGCCTTCCATCATAGCATGCGTTCCATCAGTGAATAAATT<br>TGTCTTCCGAGCTGAGGACACATTTATCGCTCAATGGCCGAATGTCG<br>ATATTATGGGCACGAATTCTCTAGGGGCGGTTCACGGAAAGGCACAT<br>GACAGGCTCAGGAGCTTTGTCTTGAATGCCGTTAACCGACCTGATGC<br>TCTTCGTCGTATAGCTGCTTTGGTACAGCCGCGTTTGGTTTCTGCCC<br>TCGAGTTGTGGGCCCAAAAAGGCAGAATTGTTGCTTTTCATGAAACT<br>AAGAAGGTGACCTTTGAGAACATCGGGAAGCTGTTTGTGAGCTTTGA<br>GCCGGGGCCACAATTGGAAAAGATCGATGGGTTATTTCATGACATGC<br>TCAAAGGAATGAGAGCTCAGCGGCTCAATTTTCCTGGAACTGCATAT<br>CGCTGCGCTCTGCAGGCCCGGAAGAAGGTTGAGGCTATATTCAGAGT<br>AGAGCTAGAGGAAAGGAAAAGCCGAAGTGAAGAAACTGTGACCGATC<br>TTATGGATGAGTTACGACAAATCAAAGATGAGGAAGGCAGAAAACTA<br>TCTGACCAAGAAGTGCTAGATAACATCGTCAGCTTTGTGTTCGCCGG<br>TTATGAGTCCACTTCACTTGCATCGATGTGGGCAATTTACTATCTTG<br>CCAAGTCTCCCAATGTTCTAAAGAAACTCCGGGAAGAGAACACGTCT<br>GTTAGCCAAACAAGAAGGGGGAGTTCATCACGAGTGAAGACATCTC<br>GAACATGAAATATACTAAAAAGGTGGTGGAGGAGACACTAAGAATGG<br>CCAATATTTCACATTTTCTTTTCAGATTAGTCACAAAGGACATCGAG<br>TACAAAGGTTATAGAATACCAAAGGGATGGAAAGTGATTCTGTGGCT<br>CCGGTACCTCCACACGAACCCGGAAAACTTTGATGACCCAATGTGCT<br>TTAATCCAGAGAGGTGGAACGATTCTGTGAAACCGGAGGCATACCAA<br>GTGTTTGGTGGGGATCGAGAATCTGTCCAGGAAACATGCTTGCGAG<br>AATTCAGCTGGCTATTTTACTGCATCACTTATCAGTAGAATACAAGT<br>GGGAATTGATCAACTCGGATGCAGGCTTTGTCTATCTTCCCCACCCC<br>GCACCAGTTGATGAAGTTGAAGTCAGTTTCAGCAAGTTATGAGGAAT<br>GATTTGTTGGAATTTTGTTTGTTAAAACAAAATGAGTGCCTTTTAAT<br>TTGTCCCACATAGAAAATGTGGGAGCAGGAGGGTTAGTTTATTAATG<br>TAGGATTTCCCTTTTATAGTTAAAAGAGTGATTAGGTGGGGTTAGAC<br>CTCACCATGCCAAAAAAAAAA |
| 91 | ACAACGCTCAAGAAGAAAATTTCGAAACGATCTCTCGCCCTCCGTTC<br>CGCTATAAATAGCACCCGAGCACCAATACTCTTTCCATCATCTTCAA<br>AACAACTGTCTCTGTCTCTCTCTGTCCCTCTCTCTCTCTCTCT<br>CGATTCTCTCCCTAGTCCATTAGTTCTCGTTGCCGCTTCGTAAACAA<br>GGAAGCACGGCGCACGGCCGTCCGATGGTTGTCCCGTCCAAACTAGC<br>AATTGAACAGTTCTCCTACGTTATGAACAGCAACGCATTATCATCCC<br>ACCAAATCCCTGTCGTGGACCTCTCGAAGCCCGACTCCAAGAGCCTC<br>ATCATCAAGGCCTGCGAAGAGTGCGGCTTCTTTAAGGTCGTGAACCA<br>CGGCGTCCCGTTGGATTTTATCTCCAGGCTGGAGGAGGAAGCCGTCA<br>AGTTCTTCTCTCTGCCTCTCCCCGAGAAGGAGAGGGCAGGCCCTCCT |

TABLE 2-continued

Cell Signaling Gene Sequences

| SEQ ID NO | Sequence |
|---|---|
| | GACCCGTTCGGCTATGGCAACAAGATGATTGGCCGGAACGGAGATGT GGGTTGGATCGAATACCTCCTCCTGACGACCGATCCCAACTTCAACT ACCGCAAGCTCCCATCGGCTTTTAACGAAAACCCAGAAAGATTTCGC TCTGCTTTGAGTGATTACACATCGGCGGTGAGGTACATGGCGTGTGA GATTCTCGAGTTGATGGCCGACGGATTAAGGATTCAACAGAGGAATA TATTTAGCAAACTTTTGATGGATGAACAGAGCGACTCTGTTTTCAGG CTCAACCACTACCCTCCATGCCCGGAGCTTCAATCCTATGTCGATAG GAACATGATTGGATTCGGTGAACACACTGACCCACAAATCATATCTG TTCTCAGATCGAACAACACGTCTGGGCTCCAAATATCCATGAAAGAT GGGACTTGGGTTTCTGTTCCACCGGACCAGAACTCATTCTTCATCAA TGTTGGTGACTCCTTAGAGGTGATGACTAACGGGCGATTCAGAAGCG TGAGGCACAGAGTCCTGGCGAACACCTCGAAGTCCAGGGTCTCGATG ATATACTTCGGAGGACCACCTTTGAGTGAGAAGATAGCGCCATTGCC GTGCCTCATGAAGGGCAAAGAGAGCCTGTACAAGGAGTTTACATGGT TCGAATACAAGAAGTCCGCCTACAACACGAGGTTGGCTGATAACAGG CTAGAGCATTTTCAGAGAGTAGCCGCTTCTTGATGTCGCTCAGAGCG CCAGATGTCAGCAGCAAGAATGGGTTCTTAGGACAGCAACTTTCATC TTCATTTTGTTCCTTCCTTGTCTCTCTGTATTTTCCATCGGTACTTT CTTGTTCAAACGATGTAAATTACTCTCTTCTTGTCAAATATCACAGA GCGTCCATGGTCTGCCACTATCTCTATTTGACAATTTGTAATATGTA ATTTTCAATGAAGTCACAGTCACAAGTCACCTTTCAGACAAAAAAAA AA |
| 92 | GACATTTACAGCTCTGAGAAGGAGGGTAGGGAGTGAGTGTGGTGGGC TTTTTTTTAGCTTCTTGGGAGCAGCAACAATGGCTGTTTACATCTTC TTGGCTCTTGGGGTGGTGTTGGTGCTCTGTGTATGCACTGCCTTGCT GAGATGGAACGAGGTAAGGTACATGAAGAAAGGTCTGCCTCCGGGCA CAATGGGTTGGCCAGTCTTTGGTGAGACCACCGAGTTCCTCAAGCAA GGCCCTAACTTCATGAAAAACCAGAGTGCCAGGTATGGGAGCTTCTT CAAGTCCCACATCCTGGGGTGCCCCACGATAGTGTCCATGGACCCAG AGGTGAACCGGTACATCCTGATGAACGAGGCCAAGGGGCCTCGTCCCG GGTTACCCGCAGTCCATGCTCGATATTCTGGGCAAGCGCAACATAGC GGCGGTTCACGGCGCGTCCCACAAGCACATGAGGGGTGCTCTGCTCT CCCTGGTCAGCCCCACCATGATCAGGGACCAGCTCTTGCCTAAGATC GATCGGTTCATGCGATCCCACCTCGCCCGCTGGGACGATGGCTCCAT TATTGACCTCCAAGACAAGACCAAACAGATGGCACTCCTCTCGTCGC TGATGCAAATCGGAATCGACTCCAGCTCCATTTCCCAAGAATTCATA CCCGAGTTCTTCAAGTTAGTCCTGGGCACTCTCTCCCTGCCTATAGA CCTCCCGGGCACAAACTACCGTCGAGGTTTCCAGGCTAGGAAAAATA TACTAGGCATGTTGAGGAAACTGATAGAAGAGGAGGGCCTCCCAG GAAGCCCACAATGACATGCTTGGTTGCCTCATGAGGAGTGATGATAA CAAATACAAGTTGAATGATGAAGAGATCATTGACCAGATAATCACCA TCATGTATTCCGGGTACGAGACCGTTTCGACCACGTCCATGATGGCT GTCAAGTATCTCCACGACAACCCGAGCGTTCTTCACGAATTAAGGAA AGAACACTTGGGGATTAGAGCGAAGAAAAGGCCGGAGGATCCTATCG AGTGGGACGACCTCAAAGCGATGCGGTTCACTCGTGCGGTCATATTT GAGACCTCCAGATTGGCCACAGTTGTCAATGGGGTCTTGAGAAAAAC CACTAAAGACATGGAGCTCAACGGGTTCTTAATCCCAAAGGGATGGA GGATATACGTTTACACGAGAGAAATAAATTACAATCTGCGATTATAT CCCGATCCACTAGCTTTCAATCCATGGAGATGGCTGGACAAAAGCGT GGAGTGTCAAAACTACAACCTAATTTTCGGTGGGGGCACAAGGCAAT GCCCTGGAAAGGAACTTGGGATTGCCGAAATCTCCACATTTCTTCAC TACTTTGTGACCAGATACAGATGGGAAGAGATTGGGGGAGACAAGCT AATGAAATTTCCAAGAGTAGAAAGCACCAAATGGGCTGCACATAAGG GTTTCCCCTCAATGCTGACTTCACTCCAATATTCTTATGTACAGAAG AAACCAAAAGAGGAAAAAACAAGAAGCACGACAAGTACAGATGTATA TTAATGATTTTTGATAGATTTAAGTAGGAAAGTGCACCAAAAAAAAA A |
| 93 | GGGACACGATATCCTCCCATTTAGTCAGCATGATGTGTCAAGATTAA AACCCACAGTGACGGGGCTCACAAGTATCTTGGCAAATTTGATGGAT CCCATTTTTCGTTGGTGCTTCGTATGTTTTCTTTGTGAGTGGTAG CTGCAGGAGCTGTGAGTTTCGATCTCAGTTCGATTAATTTAGCCAAA GAAAATGAGTGCCGAGAAAGAGAGGGAGAGCCATGTTTTCATGGCCA AGTTAGCCGAGCAGGCCGAGCGTTACGATGAGATGGTGCAGTCAATG AAGGATGTTGCCAAATTGGATCTAGAGCTGTCTGTAGAGGAAAGAA CTTGCTTTCTGTTGGATATAAGAATGTTATTGGTGCCAGGAGAGCAT CATGGCGGATTATGTCCTCCATTGAGCAGAAAGAAGAAGCAAAGGGA AATGAGCAGAACGCGAAAAGGATCAGGGATTACCGTCAAAAGGTGGA GGATGAACTCTGTAGAATCTGCAATGACATTCTGTCAATTATTGATG ATCATCTCCTTCCTTCTTCTTACCTCAGGAGAGTCCACAGTCTTTTAC TATAAGATGAAAGGCGATTACTACCGATATCTTGCTGAATTTAAATC TGGAAATGAAAGGAAGGAGATTGCTGATCAATCTTTGAAGGCTTACG |

TABLE 2-continued

Cell Signaling Gene Sequences

| SEQ ID NO | Sequence |
|---|---|
|  | AGGCTGCTTCAAATACTGCAGCTACAGATCTGCCTCCCACACATCCA<br>ATCAGGCTTGGCTTAGCACTAAACTTTTCAGTTTTCTATTATGAAAT<br>TCAGAACTCTCCTGAAAGAGCATGTCACTTGGCAAAACAAGCATTTG<br>ATGAAGCCATTGCAGAGCTGGATACTCTCAGTGAAGAATCATACAAG<br>GACAGCACATTAATAATGCAATTGCTGAGAGACAATCTTACATTATG<br>GAGTTCTGATTTGGAAGATCTTGGAGGGGATGATCAGCCTAAAGGAG<br>AAGAGGCGAAGGTGGAAGATGGGGAACCCTAATTTTGTTGCAATAGC<br>GTTTCTTCGGCAGTTGGATTGCTTGGAGGATTTTTGATATTCTTCCT<br>GGCGTACTTCCTCAGTCTTTTTGTTTTGAGTGGATGTTTATATCAC<br>TTTGATGCAATACAGTTTCACTTGCATTGTGAGTTTTTTTTTCTAG<br>ATTGACATCCTTCGTTGGTTCTCAAAGTA |
| 94 | GAGAGCAGGTTGAGGAGGGCGTAAGTTAAATCAGCCTAGATCTCTTC<br>GACTCCATCTTCATTCAACATAAGCTCGAACTCATCATGTCGGCCCG<br>CAGAAGAACTCTTTTAAAGGTTATCATCCTTGGCGATAGCGGGGTTG<br>GTAAAACCTCGCTGATGAATCAATATGTAAACAAGAAATTCAGCAAC<br>CAGTATAAAGCAACCATTGGAGCTGACTTCTTGACTAAAGAAGTTCA<br>GTTCGAGGATAGATTGTTCACGTTACAGGAAAGATTTCAGAGCCTTG<br>GTGTTGCCTTCTACCGTGGTGCCGATTGCTGCGTTCTTGTTTACGAT<br>GTTAATGTGCTAAAATCATTTGATAACCTAAATAATTGGCGCGATGA<br>ATTTCTAATTCAGGCAAGCCCTTCTGATCCGGAGAATTTTCCATTTG<br>TTGTGCTTGGAAATAAAATTGACGTGGATGGTGGGAACAGCAGAGTG<br>GTCTCTGAGAAAAAGGCCAGGGCATGGTGTGCTTCTAAAGGCAACAT<br>TCCCTACTTTGAAACTTCTGCAAAAGAAGGCTTTAATGTTGAAGCAG<br>CTTTCCAATGTATAGCCAAGAATGCATTGAAGAATGAGCCCGAAGAG<br>GAAATATATCTCCCGGACACAATTGATGTCAATGCTGGGAGACCACA<br>AAGAACATCAGGATGTGATTGTTAGTCACCAGGGGATTGTACAAGAC<br>TTTGATGCTACAAATAATAGTTTACTTGCATCGTAAGATATCGAACT<br>TGAATCAGGCCATTGGGTGTTAATCAAACGTTTACTTGTGTAACCA<br>GTGTAGAGATAGAATTGTACTCTAGTAATGCTCATTAAAAGTTAGAT<br>TGTTGTTTTGCAATTTCGCAAAAAAAAAA |
| 95 | CATTCCCCAATCCCCTTTTTACTTTTTGCGGAACAGGGACCGGGGGC<br>AGCGATCTATTGACCAGAGACCAGAGAGCAGGTTGAGGAGGGCGTAA<br>GTTAAATCAGCCTAGATCTCTTCGACTCCATCTTCATTCAACATAAG<br>CTCGAACTCATCATGTCGGCCCGCAGAAGAACTCTTTTAAAGGTTAT<br>CATCCTTGGCGATAGCGGGGTTGGTAAAACCTCGCTGATGAATCAAT<br>ATGTAAACAAGAAATTCAGCAACCAGTATAAAGCAACCATTGGAGCT<br>GACTTCTTGACTAAAGAAGTTCAGTTCGAGGATAGATTGTTCACGTT<br>ACAGATATGGGATACCGCTGGCCAGGAAAGATTTCAGAGCCTTGGTG<br>TTGCCTTCTACCGTGGTGCCGATTGCTGCGTTCTTGTTTACGATGTT<br>AATGTGCTAAAATCATTTGATAACCTAAATAATTGGCGCGATGAATT<br>TCTAATTCAGGCAAGCCCTTCTGATCCGGAGAATTTTCCATTTGTTG<br>TGCTTGGAAATAAAATTGACGTGGATGGTGGGAACAGCAGAGTGGTC<br>TCTGAGAAAAGGCCAGGGCATGGTGTGCTTCTAAAGGCAACATTCC<br>CTACTTTGAAACTTCTGCAAAAGAAGGCTTTAATGTTGAAGCAGCTT<br>TCCAATGTATAGCCAAGAATGCATTGAAGAATGAGCCCGAAGAGGAA<br>ATATATCTCCCGGACACAATTGATGTCAATGCTGGGAGACCACAAAG<br>AACATCAGGATGTGATTGTTAGTCACCAGGGGATTGTACAAGACTTT<br>GATGCTACAAATAATAGTTTACTTGCATCGTAAGATATCGAACTTGA<br>ATCAGGCCATTGGGTGTTAATCAAACGTTTACTTGTGTAACCAGTG<br>TAGAGATAGAATTGTACTCTAGTAATGCTCATTAAAAGTTAGATTGT<br>TGTTTTGCAATTTCGCAAAAAAAAAAAAAAA |
| 96 | AAGCGGTGGTATCAGCGCAGAGTACGCGGGGACTCCTTATATTGTCT<br>CTCTGTGTTGAATGCTGTGACCATGAAGCGGGCGAGCTATGCATGCA<br>TATCGGACGAAGCCCTGGAGTGCGTTATGGGCCACCTGGAGGATCCG<br>AGAGACCGTGGCTCGGTCTCTCTGGTCTGCAAGAAATGGTACGACGT<br>GGATGCCTTCACGAGGAAGCACGTGACCGTGGCCTTCTGCTACTCAA<br>TACACGCCAGCGACCTTACCCGCAGGTTCACCAGGCTGGAGTCCCTT<br>ACGGTCAAGGGGAAACCCAGAGCGGCCATGTATAATCTGCTCCCTCA<br>CGATTGGGGGGGTTATGCCAAGCCCTGGATAGACCAGATCTCCTTCA<br>CCTGTCTCTGCCTCAAGGCGCTCCATCTGCGCAGAATGATTGTTACC<br>GATGATGATCTCACCACTCTCGTCAGGGGCCGCGGTCACATGTTGCA<br>GGAGCTCAAACTCGAGAAGTGCTCTGGGTTCTCTACAAGGGGCTTG<br>AGGAAGTGGCTCACGGTTGCAGGTCTCTTAAGATCTTAATGCTGGAC<br>GAGAGTCAAATTGAAGAGGAAAGCGGGGACTGGCTACATGAGCTTGC<br>TCTTAACAATTCTTCTTTGGAAGTGTTGGACTTCTACATGACAACAT<br>TAGAAATGATCAATACCAGTGATCTTGAGCTAATAGTAACAAACTGC<br>CCCTCATTAACATCATTAAAGGTTGGAGAATGTGATATAGTTGAGAT<br>GAGAGGCGTTCTGAGTAAGGCTACTGCATTGGAGGAGTTTGGTGGTG<br>GGACATTTAACAACAGTGAAGAGCATGCGACGGAGACCAGTATGATT<br>ACATTTCCTCCAAAGTTGACATCATTGCTAGGACTAAACTTCATGAT |

TABLE 2-continued

Cell Signaling Gene Sequences

| SEQ ID NO | Sequence |
|---|---|
| | TGAGGCTGAGATGCCTGCTATATTCCCAAGAGCTTCGGCCCTTAAGA |
| | GATTGGATCTGCAGTACACATTCTTGAGCACAGAAAATCACTGTCAG |
| | TTGGCAGGGCTCTGTCCTAATCTTGAAATTCTCGAGGTTAGAAATGT |
| | TATCGGAGACAAAGGGTTAGAAGTTGTTGCTAATACTTGCAAAAAGC |
| | TGAAAAGACTTAGAGTGGAACGAGGAGCAGACGACCCAACTTTGGAG |
| | GACGAACAAGATAAAGAAGAGCACATCGCTGATTTACCGCTGGACAA |
| | TGGAGTCAGGGCTTTGCTACGTGGATGTCAAAAGTTGAGTAGGTTTG |
| | CATTTTATATCAGGCCTGGAGGGCTGACAGATACAGGTCTTGGTTAT |
| | ATTGGCGAGTACAGCACTAATGTAAGGTGGATGCTTCTGGGTTTTGT |
| | TGGTGAAACTGACCAAGGCATTCTCGAGTTTTCCAAGGGCTGCCCAA |
| | AGCTGGAAAGGCTAGAAATTAGAGGTTGTTGTTTTAGTGAATCTGCA |
| | TTGGCAGCTGCAGTGCTTCAGCTGAAATCGCTGAAGTACATATGGGT |
| | TCAAGGATATAATGCAACTGTTACTGGTGCTAACCTTCTAGCGATGG |
| | CTCGACCTTATTGGAACATAGAATTTTCTCCTGCTTTGCAATCGAGT |
| | GATGTGTTTGCTGAAGATATGGCAGAAGAAAAAAAACAGGATCAGGT |
| | AGCACAACTTTTGGCCTACTATTCTCTTGCTGGAAGGAGGACAGATC |
| | ACCCAGAGTCCGTAATTCCTTTAGCTCCACTTTTCTGGAATTGCCAT |
| | CAAGTAACTGTCTTCTAATGTGAATATCTATATAAAATATGAGTCCC |
| | AAACTTGCATGGAGGTATATAAATATAGAACATGCAAAGATGCTTCT |
| | TTCTCTCCCGTTTCCTTCAGATTTCTTTTGTGATAGTAGTGTGACTA |
| | GCACTTACTATGCCTAACAGTCTGATGGAAGAAAGGTACGTTGAGAC |
| | TTATCTCTCTTCCTAATTCTCTATGGCAGTGGATGTAGTCATTCTAC |
| | CTCATAACGTGTCTGTTTATTGATGGAAACTTCTTCCCAGTGTGATG |
| | AACTCTTCTGGAGAGTTCTAGGGGATGTCTTGGTAGGTTCAATGGGA |
| | TGTCTTCTGAATATCATAATCTTCATATTTCTATCAATGAAGACATT |
| | GCTGAAAGAAGTGGTTACCACAAAAATCCATGTAAGTACAAGGGGTA |
| | TTGCACTGACAAAAAAAAGTTCGTCCTTGGAAAACTGAAATGTTTAT |
| | TTTTTCTTCTAAGCTGGTTACGGATATTTATGGAGTTGAGATGTACG |
| | TAATCGCGAAGGTGTACAGTCAAAACGGGTATGTTTCATACTTTGAC |
| | TTGGTGGGCTACAAGTCAAAACTTACAGTGGACATACCGTGCTTCTT |
| | TTCCTAGTATGCTGGTAACATCAGTGCTGAAGTCAACAGGCCTCTGG |
| | TTTTCAACGACATTAAGTTGTGGGTATGCTTAAGGACATCGAAATAC |
| | CAAGGGCACTAGAGTTCAAGTAGACGTTTATAATTTAACCGGCCATT |
| | CAACATCCTGAGTTTGTAGCATGAGAAGCCACTTGTCTTATTTTCAG |
| | TTCTTGGTAGGGAGTTCAGAATTAGGGGGTGATTTGAGAACATCATA |
| | AATAATGTCATATTTTATATCCAGAGACTTGAACTATTTGTATGTTG |
| | TAATTCATATTGGTTGACATGATTGATATGTACATATGTTACATGGT |
| | ATTAGCATGAGGATGTTGATGTTTGACCTTAAAAAAAAAA |
| 97 | GCCGTCGGATCCACTCCCCGGCGGCCACGATCGGTTTGCTTTCCCTT |
| | TTGTCGTCTGACACCTTTTCCCGACCTACAGGAAGCATAGATTTTTA |
| | CTGTAAGATGCGATGAGTGAGCAATGAGCGATGGGCATGTCGCAAAA |
| | TTAGAGATAAGATCACCAAGGAACCAACAAAATCAGAGGCCGAGGAC |
| | CTCGACCAGGGGCTCTCTGTGTATATAGCTTTGAAGTCCATATGAAT |
| | ATATTCACTCCTTATATTGTCTCTCTGTGTTGAATGCTGTGACCATG |
| | AAGCGGGCGAGCTATGGATGCATATCGGATGGATGCATATCGGACGA |
| | AGCCCTGGAGTGCGTTATGGGCCACCTGGAGGATCCGAGAGACCGTG |
| | GCTCGGTCTCTCTGGTCTGCAAGAAATGGTACGACGTGGATGCCTTC |
| | ACGAGGAAGCACGTGACCGTGGCCTTCTGCTACTCAATACACGCCAG |
| | CGACCTTACCCGCAGGTTCACCAGGCTGGAGTCCCTTACGGTCAAGG |
| | GGAAACCCAGAGCGGCCATGTATAATCTGCTCCCTCACGATTGGGGG |
| | GGTTATGCCAAGCCCTGGATAGACCAGATCTCCTTCACCTGTCTCTG |
| | CCTCAAGGCGCTCCATCTGCGCAGAATGATTGTTACCGATGATGATC |
| | TCACCACTCTCGTCAGGGGCCGCGGTCACATGTTGCAGGAGCTCAAA |
| | CTCGAGAAGTGCTCTGGGTTCTCTACAAGGGGGCTTGAGGAAGTGGC |
| | TCACGGTTGCAGGTCTCTTAAGATCTTAATGCTGGACGAGAGTCAAA |
| | TTGAAGAGGAAAGCGGGGACTGGCTACATGAGCTTGCTCTTAACAAT |
| | TCTTCTTTGGAAGTGTTGGACTTCTACATGACAACATTAGAAATGAT |
| | CAATACCAGTGATCTTGAGCTAAGTAACAAACTGCCCCTCATTAACA |
| | TCATTAAAGGTTGGAGAATGTGATATAGTTGAGATGAGAGGCGTTCT |
| | GAGTAAGGCTACTGCATTGGAGGAGTTTGGTGGTGGGACATTTAACA |
| | ACAGTGAAGAGCATGCGACGGAGACCAGTATGATTACATTTCCTCCA |
| | AAGTTGACATCATTGCTAGGACTAAACTTCATGATTGAGGCTGAGAT |
| | GCCTGCTATATTCCCAAGAGCTTCGGCCCTTAAGAGATTGGATCTGC |
| | AGTACACATTCTTGAGCACAGAAAATCACTGTCAGTTGGCAGGGCTC |
| | TGTCCTAATCTTGAAATTCTCGAGGTTAGAAATGTTATCGGAGACAA |
| | AGGGTTAGAAGTTGTTGCTAATACTTGCAAAAAGCTGAAAAGACTTA |
| | GAGTGGAACGAGGAGCAGACGACCCAACTTTGGAGGACGAACAAGGT |
| | TGGATTTCCCACAAAGGGCTTTCCTTGGTAGCTCAAGGCTGCCCCCT |
| | TCTTGAGTACATTGCCGTCTATGTTTCAGATATATGCAACTCAACCT |
| | TGGAGACCTTTGGTCAATGTTGCAAAAATCTCAAGGATTTCCGGTTG |
| | GTCTTGTTAGATAAAGAAGAGCACATCGCTGATTTACCGCTGGACAA |
| | TGGAGTCAGGGCTTTGCTACGTGGATGTCAAAAGTTGAGTAGGTTTG |

TABLE 2-continued

Cell Signaling Gene Sequences

| SEQ ID NO | Sequence |
|---|---|
|  | CATTTTATATCAGGCCTGGAGGGCTGACAGATACAGGTCTTGGTTAT<br>ATTGGCGAGTACAGCACTAATGTAAGGTGGATGCTTCTGGGTTTTGT<br>TGGTGAAACTGACCAAGGCATTCTCGAGTTTTCCAAGGGCTGCCCAA<br>AGCTGGAAAGGCTAGAAATTAGAGGTTGTTGTTTTAGTGAATCTGCA<br>TTGGCAGCTGCAGTGCTTCAGCTGAAATCGCTGAAGTACATATGGGT<br>TCAAGGATATAATGCAACTGTTACTGGTGCTAACCTTCTAGCGATGG<br>CTCGACCTTATTGGAACATAGAATTTTCTCCTGCTTTGCAATCGAGT<br>GATGTGTTTGCTGAAGATATGGCAGAAGAAAAAAAACAGGATCAGGT<br>AGCACAACTTTTGGCCTACTATTCTCTTGCTGGAAGGAGGACAGATC<br>ACCCAGAGTCCGTAATTCCTTTAGCTCCACTTTTCTGGAATTGCCAT<br>CAAGTAACTGTCTTCTAATGTGAATATCTATATAAAATATGAGTCCC<br>AAACTTGCATGGAGGTATATAAATATAGAACATGCAAAGATGCTTCT<br>TTCTCTCCCGTTTCCTTCAGATTTCTTTTGTGATAGTAGTGTGACTA<br>GCACTTACTATGCCTAACAGTCTGATGGAAGAAAGGTACGTTGAGAC<br>TTATCTCTCTTCCTAATTCTCTATGGCAGTGGATGTAGTCATTCTAC<br>CTCATAACGTGTCTGTTTATTGATGGAAACTTCTTCCCAGTGTGATG<br>AACTCTTCTGGAGAGTTCTAGGGGATGTCTTGGTAGGTTCAATGGGA<br>TGTCTTCTGAATATCATAATCTTCATATTTCTATCAATGAAGACATT<br>GCTGAAAGAAGTGGTTACCACAAAAATCCATGTAAAGTACAAGGGGT<br>ATTGCACTGACAAAAAAAAGTTCGTCCTTGGAAAACTGAAATGTTTA<br>TTTTTTCTTCTAAGCTGGTTACGGATATTTATGGAGTTGAGATGTAC<br>GTAATCGCGAAGGTGTACAGTCAAAACGGGTATGTTTCATACTTTGA<br>CTTGGTGGGCTACAAGTCAAAACTTACAGTGGACATACCGTGCTTCT<br>TTTCCTAGTATGCTGGTAACATCAGTGCTGAAGTCAACAGGCCTCTG<br>GTTTTCAACGACATTAAGTTGTGGGTATGCTTAAGGACATTGAAATA<br>CCAAGGGCACTAGAGTTCAAGTAGACGTTTATAATTTAACCGGCCAT<br>TCAACATCCTGAGTTTGTAGCATGAGAAGCCACTTGTCTTATTTTCA<br>GTTCTTGGTAGGGAGTTCAGAATTAGGGGGTGATTTGAGAACATCAT<br>AAATAATGTCATATTTTATATCCAGAGACTTGAACTATTTGTATGTT<br>GTAATTCATATTGGTTGACATGATTGATATGTACATATGTTACATGG<br>TATTAGCATGAGGATGTTGATGTTTGACCTTATTTAAGTGTTCGTAG<br>GTTGTAATTAAAAAAAAAAAAAAAAAA |
| 98 | ATTATCTCATCACAAAAATCTTTAATTTGCTCTTTGAACCATTCTGC<br>ATCATGTTTACAATAAGTACCTGTACAACTCACGCACAATCTCTGAT<br>ATACAGTTTTGTTGCGAGGGGCACCGTGGTGCTTGCGGAGTACACGG<br>AATTCAAAGGCAATTTTACAGGTATTGCCGCTCAGTGTCTGCAAAAG<br>CTTCCCGCCAGCAACAACAAGTTCACATACAATTGCGATAATCATAC<br>CTTCAACTACCTTGTTGAAGATGGCTTCGCATATTGTGTTGTTGCAG<br>ATGAATCCGTTGGAAGGCAAGTACCAATGGCATTTCTGGAGCGTGTT<br>AAGGAGGATTTTAAGAGGAGATATGGTGGTGGAAGAGCTGACACAGC<br>TGTTGCTAACAGCTTGAACAGAGATTTTGGGTCAAAATTGAAAGAGC<br>ACATGCAGTATTGCATTGACCACCCTGAAGAGATCAGCAAACTTGCA<br>AAAGTCAAGGCCCAGGTTTCTGAAGTGAAAGGTGTCATGATGGACAA<br>CATTGAAAAGGTTCTTGACCGTGGTGAGAAGATTGAACTTCTGGTTG<br>ATAAAACAGAAAACCTTCGTTTTCAGGCTCAAGACTTCCAAAAGAAG<br>GGAACCGAGTTGCGCAGAAAGATGTGGTTTCAGAACATGAAAGTGAA<br>ATTGATTGTCCTTGGAATTGTGGTGGCCTTGATTCTCATAATTGTCC<br>TTTCAGTATGCCATGGATTCAATTGTTCGAAAAAATGATCTGGAATA<br>GATAGAGGTCCATTTGAATTGGAACAACTTTTGATTGGCTATGGATG<br>GCATTCTTGTTCTCCTTTGTATTTCTCTCTATATTATCAGTTTCGGG<br>TGAGATAGTTCTATGATGTTTGCCAGAGGGTATTTTGCTTGGACAAT<br>CACTGGTTGATAGTACATATTGACTAGTATGACAACGAAATGTTCTG<br>AATATTCAGTGGGGCAGAGACTCTGATTGCGTACAGCAACTTTAGTG<br>TATTATATCAAGGTCATGCATTTGTTATAAAAAAAAAA |
| 99 | CCCAAATTAAAAAGTCGAGCGCTTAATGAAATGATAGTCGTCAGATG<br>ACGTCCGAGGGGTTTCAAATAATTCTTAGCCGTCCATTTCGTAGAAC<br>ATCGGTACTCCATCAATTTTCCTGCTCATCTTACCCTCATTTTGTAA<br>TTCTCTTCCTGGCGGAGGGTTTGGAAGCTGGGGAAATCAGGCGAAAT<br>AAATAGGGAATTGGGACTGTTTGCTGCAAATATCGTTTTTATTCGCC<br>GAAAATCAGCTTTGGGTCTGTGATTTGGCCTTCTGCGTTCGATTCTG<br>CGCGTTTTCAGCTTCATTTCCAAGGCCTTTTCGTCAGGTTTGGCTAA<br>AAAATGACCACCGAAAAGGAGAGGGAAAATCATGTATACATGGCCAA<br>GCTCGCCGAACAGGCCGAACGATACGACGAAATGGTGGATTCAATGA<br>AGAAAGTGGCCAAATTAGACGTTGAACTGACAGTCGAAGAAAGAAAT<br>CTGCTTTCTGTTGGCTATAAGAATGTTATTGGTGCTAGGAGGGCTTC<br>CTGGCGGATTATGTCGTCCATTGAACAAAAAGAGGAGGGTAAGGGTA<br>ATGACGTGAATGCAAAGCGAATCAAGGATTATCGTCACAAAGTTGAG<br>ACAGAGCTGTCTAGAATCTGTGGAGACATTTAACCATTATTGATGA<br>ACATCTTATTCCATCTTCTAGCTCTGGAGAGTCTATGGTCTTCTATT<br>ACAAGATGAAAGGAGATTACTATCGTTATCTTGCTGAATTTAAAAGT<br>GGTAGTGATAGGAAAGAAACTGCTGATCAGGCCCTCAAAGCATACCT |

TABLE 2-continued

Cell Signaling Gene Sequences

| SEQ ID NO | Sequence |
|---|---|
| | GGCTGCTTCAACCACTGCAACAACAGATTTGCCTCCAACTCATCCCA<br>TCAGGCTTGGCCTTATTCTGAATTTCTCAGTGTTCTATTATGAAATT<br>CTTAACTCTCCTGAGAGAGCATGTCACTTGGCCAAACAAGCGTTTGA<br>TGAAGCAATTGCAGAACTTGATTCTCTTAGTGAAGAGTCGTACAAGG<br>ATAGCACATTAATAATGCAGCTACTAAGAGACAATCTTACCCTTTGG<br>ACTTCAGATTTGCAAGAAGATGGAGGAGAAGAGCAGCTCAAAGGTGA<br>AGAGATTAAGCCAGAAGATGGAGAGCATTAACACTAAAAGGGGAGCA<br>GAACGAGTTTATGCATGAGAAGCTATGATCCCATGGTTATTAGGGTG<br>TAGGTCATTATTTAATTGGTAGTTCTTTCACATTTTCTGCTGCTTTG<br>GAGATGTAGATATTACTTCAGCCCATTTGGTTATATGGGATTGAATT<br>TTAGCTGATTTGGCATTGGACTTGTTTAGCTATATAGGTTCAGATGT<br>ATAAAACTTTCTATTCTGGGATCTAGGTTTTTTCGGCTGGAACTCGG<br>GTGTATCTCTTTGGGGATTAAATCTGCATCCGAAGGTGTTGTCCAAT<br>TTTAAAACAAAGACCACATCGTATAGTTTATATATTTGAATGTGATT<br>ACTGTTGAAGCATCAAAAAAAAAAAAAAAAAAAAAAAAAAAAAAAAAA<br>AA |
| 100 | GGGTATATAGAGGAAAAGGCAAGCTTTCTGTTTCAAAGGGAAGATGA<br>GTTCAAGGGAGAGAAAAGCGAGGGTGGGTTTGAAGCTGCCAATCCCA<br>GCTCGGGAAGACGCATTTGCTAAACCAATGCCATTGCCGCTTCCACT<br>GCCGAAGCCTCCTAACATGAATGGTGCCTGCAAGTTGCCCTGCGTTC<br>CTCTTGAAGAAGTTACACTGGAAGATCTCCAGAAGATTTCAACTTTG<br>GGGTGTGGGAGCAGTGGTAAAGTGTACAAGGTTAAGCATGCCAAGAC<br>TGGGAAAATTTATGCCCTCAAAATCATTCAGGAAAAGCACGAGCTTG<br>CTGTCCGAAAGCAAATAATGAGGGAAATGGAGATTCTCCGAAGGGCG<br>AATTCTCCACACATCGTGCAGTGTTATGGCATATTCGATCGAGGAGG<br>AGAGATCTCGTTTGTGTTGGAGTACATGGACGGTGGAACCCTTGCGC<br>AGGTTCTTCAAGCCCACAAGAAAATCCCAGAACACTATTTGGCTGAG<br>GTTGCCAGACAGGTGCTGAAGGGCTTGCATTACCTGCACCAGAACAA<br>AATTGTTCACCGTGATATAAAGCCCTCCAATTTGCTGATCAACAAGA<br>GAAGAGAAGTGAAGATTGCCGATTTCGGTGTCAGCACTGTGTTGGCT<br>CACACTTTGGCCCAGTGTAATTCCTTCGTGGGTACTTGTGCTTATAT<br>GAGTCCTGAAAGGTTCGATCCTGATGGGTACGGTGGAAAGTATGATG<br>GATGCTCTGCAGATATATGGAGCTTGGGATTATCTTTGCTGGAATGT<br>GCGCTTGGAAGGTTCCCTTGTTTGTCTCCGGGGCAGAGGCCTGATTG<br>GCCTACTTTAATGGTGGCCATCTGTTTGGGCGACCCTCCATCCCCGC<br>CACCTGATGCATCGCCAGAGTTTCAGAGTTTTATCAGATGTTGCCTT<br>CAAAAGGATGCGTTACTTCGCCATACTGCACATCGGCTGCTTTCGCA<br>TCCTTTTTTGAAGAAGTATGAACAGCAATCTTGTGACCTGGCTCCCC<br>TCCTGCAGTCTTTACACTTGTAGAATTTTGAATTCCTTTTTGTATTT<br>TGAATATTGTACCTGAGAGCATTCATTGACTTGTAATGAATGTACAC<br>TCTCTTGGTCTCTGGAACTCTATTTTGTAAATCATTTTGCAATGCAA<br>CTGCAGTCTTCTTTACAAAAAAAAAA |
| 101 | AAAAGGTTTCCATCTAGACCGTCCATACCCTCACAGGGACGACGCAC<br>GGGGTGACGTGGAACACCTGGTTCGGCTGACACGTGTCAGCAATGTT<br>CATAGCATGACCGGCTACAAAAGGGACTCATTGATCTTTCAGAAGAA<br>TTGAGCTTTTCTTATTGGGGAGCGAGAGGTGAATTCGTTCACAAATC<br>ATCGTCTGGTCTGCGATTGGACTTTTGCGATCATTAAATTGTCAGCT<br>ACGGATCTTCGTTCTCACTCCTCTGTTGATCCAAAAGCTGCGGAGCC<br>CGGCAATCTGCAGAAATTTTTTGAAGAATTTGAGTTTTTGAGACCG<br>GCTATCTGCAGAGAAAAATTCGAAGAATTTGAGTGCCAGCATCGAAT<br>CCCCGGACTGAATGGCGACCACTGGCACCAATAACATGCAGGCTAAG<br>CTGGTGCTTCTTGGTGATATGGGTACTGGAAAATCGAGCCTTGTTTT<br>GCGATTTGTCAAAGGCCAATTTTTGGATTATCAGGAGTCGACAATTG<br>GAGCAGCATTTTTCTCACAGACACTAGCAGTGAATGAGGTGACTGTA<br>AAATTTGAGATATGGGACACTGCAGGACAGGAAAGATATCATAGCTT<br>GGCGCCCATGTATTATAGGGGTGCGGCAGCAGCTATAATTGTTTATG<br>ACATAACAAATTTGGATTCTTTTGTCCGAGCAAAGAATTGGGTGCTG<br>GAGCTTCAAAAACAAGGGAACCCAAATTTGGTTATGGCCCTTGCTGG<br>AAATAAGGCTGATATGGCAGCAAAGAGGAAGGTCGAACCAGAGGAAG<br>CTGAAACATATGCAAAGGAAAATGGTCTATTTTTCATGGAAACCTCA<br>GCAAAGACGGCGCAGAATGTCAATGAACTGTTCTATGAAATTGCGCG<br>AAGATTACCTAAAGCCCGACCAGTGCAGCAGCCTGCAGGCATGGTTC<br>TCACAGATAGACCTGCAGAGAGTGCTAAAACTTACTCTTGCTGCTCA<br>TAAGCCCTCGATTTCGTGTCACTGAAAATTTGAAGATGCCACCTTCA<br>GCTGTAAGCAGTTATTCTATGCACATTATTTGCTACGGCTGTGATAT<br>CCGGAGGAGATGGTGGGGGGGGTTCAAGCTTTGTTTAGAACTTGCT<br>TTAAGGAATTTTAGCGTTTATGGAGAAATGTAAAAATACATATTTTG<br>GTGCTTAAATTATATCTCTGTAGTGAGTTGCGATGGTCATTGAAAGC<br>CTTCTGATACAACTCTTTGGTGCCATTTATGATGAGCTTATATTTAA<br>ATTGAAAAGCTGTGCTCTGTTTAAATACTCCGAGCTCGGAGAGGGTA<br>GATCTCTTTTGATCCTGCAATGACCTCTTGTGTTTGATTGATTGTAC |

TABLE 2-continued

Cell Signaling Gene Sequences

| SEQ ID NO | Sequence |
|---|---|
| | TAGACTATACTATGGGACGCCTAACCTGTCATTTAAAAATGTGAGAC<br>TGTTCGTAACAAAGTCTTGCTATTGCTACCTTGCATTGAAACTAATG<br>TTTTCTTGAAGCATGATGAATAAATTGGCTAATAGTGTAGTCGTTCT<br>GAAGAAAAAAAAAATTCTTCAATGGTAGAATTGGATATTTGTGATCT<br>TTGAACTTGGAATTGATATGATCAGTCATTGTGTATTATATTTCTTT<br>CTCAGAGGATGATAATCGGTTGAATTTGAATATAAATCTCTCC |
| 102 | GAAAGAAGAAGAGTACAACATCACAAAAGGCCAAAGAGCAGGTCGAG<br>GCTGCTCCCACTGAAATCTTTCGCCATTCGACTGTTAGAAAGCACAA<br>CAAAGCAGTCGTCAGCTTTTGAATACCAATTCCGTGGGCGATCGGAA<br>TCCTCCCTGCCCCTGCATCCTTTCGGCAGCTCGCGGAATAACAAGCC<br>TCTGCAGGTTTGGGGTTCTTGGATGCAGAATTAGAAGACAGCGCCAT<br>GGAAACGGGCGCTGCGGCAGTAGACGGTCACATACAGGGAATTCTGA<br>CCCATGGCGGTCAGTATGTGCAGTATAATATATTTGGGAACCTCTTC<br>GAGGTCTTCTCCAAGTACATACCCCCCATACGACCTATCGGCCGCGG<br>CGCATATGGCATTGTTTGCTCGGCAGTGAACTCGGAGACAAATGAGG<br>AAGTTGCAATTAAGAAAATTGGCAATGCTTTTGATAACAGAATTGAT<br>GCAAAGAGGACTCTTCGCGAAATTAAGCTTCTATGCCATATGGAACA<br>TGAAAATATCATTGCAATTAAAGACATCATTCGGCCACCTCAGAGAG<br>AAATTTTTAATGATGTTTATATTGTATATGAGCTCATGGATACAGAT<br>CTCTACCAGATTATACGCTCCACTCAACCATTAACAGAGGATCACTG<br>TCAGTACTTCCTATATCAACTATTGAGAGGGCTGAAGTACATACACT<br>CAGCAAACATTCTGCATAGAGATTTAAAACCCAGTAATTTGCTTCTA<br>AATGCAAACTGTGACCTAAAAATATGTGATTTTGGGCTTGCACGGAC<br>TACTTCAGAAACGGACTTTATGACAGAGTATGTTGTTACTCGCTGGT<br>ATCGTGCACCGGAACTACTATTGAATTGTTCCGAGTATACAGCAGCC<br>ATTGATATCTGGTCAGTGGGCTGCATTTTTATGGAGATACTAAAGCG<br>GGAGCCCTTGTTTCCTGGTAAAGATTATGTTCAGCAATTAAGGCTCA<br>TCACTGAGTTAATTGGTTCACCAGATGACTCTGATCTTGGCTTTTTA<br>CGGAGTGACAATGCTAGAAGATACATCAGGCAACTTCCACAGTTTCC<br>TAAGCAACCTTTTTCTCAGAAATTCCCCAACATGGCTCCAGCAGCTG<br>TAGATTTACTTGAAAAAATGCTTGTATTTGATCCAAGCAAACGCATT<br>ACAGTTCAAGAGGCCTTGAGTCACCCTTACTTGGCAAGTCTGCATGA<br>CATCAATGATGAACCCAGCTGCCCCACTCCTTTCAACTTTGATTTTG<br>AGCAGCCCTCATTCACCGAGGAACATATAAAAGAGCTCATTTGGAGG<br>GAATCTCTTAACTTCAACCCAGACATGATGCAATAGCTGGAGCAGAT<br>GGGCTTGATATTTATCTTGTAATTCCTCCTTACTGGTTATGTTATTA<br>TGCTTCTGCAAGGCAATCCTTCTCTTGGTTTGTTATTGCCTTCTGAA<br>GGTTTGCAGATCATTGTGCAGGTGTGGAAACTTGTTTTATTAGAGTT<br>AGGTTTGCTTTTATTCTTTGAAGGTCTGGTAAAAGAAAAGGAATTGA<br>TGGATATGCTTACAGATCATTGTGAAAATTGTGTATTCCTAATCTGA<br>GCCAACTATTGGCCTCTACTTTATTATCATTGGACATTAAAATGTAA<br>CTGGGAAACTTAATAATCTAAAGTAAATGCTGAAGGAATTTGTTAAA<br>AAAAAAA |
| 103 | GGTTTTAAAATCGTGGCATATGCGGGTGACAGAACAACCAGAAGATT<br>ACCTCTTCAAAATTGTTTTAATAGGCGACTCTGCTGTGGGAAAATCC<br>AATCTACTTGCAAGATATGCCCGGAACGAGTTCTATCCCAATTCCAA<br>ATCCACGATCGGAGTGGAGTTTCAGACACAGACCATGGAAATCGATG<br>GTAAAGAGATCAAAGCACAGATCTGGGACACGGCCGGCCAGGAGCGC<br>TTCAGGGCCGTGACCTCGGCATATTACAGAGGAGCCGTGGGAGCTCT<br>TGTCGTGTATGACATCAGTCGGCGCCAGACATTCGACAATATTTCTC<br>GGTGGCTCGATGAGCTGCACACGCATTCTGATATGAATGTGGTTACA<br>GTAATAGTTGGCAACAAAACCGACCTAATGGATGCCAGAGAAGTTTC<br>TACAGAAGAAGGAGCAGCATTGGCAGAGGCTCAGAACTTATATTTTG<br>TAGAGACCTCAGCACTGGATTCTACAAATGTCCAAGTAGCTTTTCAA<br>ACAGTTGTCAAAGAAATTTACAACATTCTGAGTAGGAAAGTATTGTC<br>ATGTCAGGAACAGAACTTGAATCAAAATTAACTAATGGAAAACAG<br>TCATTTTGCATGAAGCAGAAAGTGAATCTACCACGAAACAAACTGGA<br>AAGTTCTGGTGTTGTTCTGGTTAGCTTTGTTTATTTCAATACTTTCC<br>AAGGGGTTCGCAAGGTCTTTTGCAATGTCTAGCCAGATTATTCCATG<br>TGAAAGAATTCTTAAAAGTGTGATGCGG |
| 104 | CTGAATGGTGTTTTTCGGATCTTAAACATAAATTCATTATCAACTGC<br>ATTTCAAAAGCTCGGTTTCTTCCGTAGTATTCTTGCCTCCGTCGAGG<br>CCTGAATCGGTCGATTGTGGTTATTGAAGATACATTTTAGGTTTTAA<br>AATGATGTCATATGCGGGTGAAGAACAACCAGAAGATTACCTCTTCA<br>AAATTGTTTTAATAGGCGACTCTGCTGTGGGAAAATCCAATCTACTT<br>GCAAGATATGCCCGGAACGAGTTCTATCCCAATTCCAAATCCACGAT<br>CGGAGTGGAGTTTCAGACACAGACCATGGAAATCGATGGTAAAGAGA<br>TCAAAGCACAGATCTGGGACACGGCCGGCCAGGAGCGCTTCAGGGCC<br>GTGACCTCGGCATATTACAGAGGAGCCGTGGGAGCTCTTGTCGTGTA<br>TGACATCAGTCGGCGCCAGACATTCGACAATATTTCTCGGTGGCTCG |

TABLE 2-continued

Cell Signaling Gene Sequences

| SEQ ID NO | Sequence |
|---|---|
| | ATGAGCTGCACACGCATTCTGATATGAATGTGGTTACAGTAATAGTT<br>GGCAACAAAACCGACCTAATGGATGCCAGAGAAGTTTCTACAGAAGA<br>AGGAGCAGCATTGGCAGAGGCTCAGAACTTATATTTTGTAGAGACCT<br>CAGCACTGGATTCTACAAATGTCCAAGTAGCTTTTCAAACAGTTGTC<br>AAAGAAATTTACAACATTCTGAGTAGGAAAGTATTGTCATGTCAGGA<br>ACAGAAACTTGAATCAAAATTAACTAATGGAAAAACAGTCATTTTGC<br>ATGAAGCAGAAAGTGAATCTACCACGAAACAAACTGGAAAGTTCTGG<br>TGTTGTTCTGGTTAGCTTTGTTTATTTCAATACTTTCCAAGGGGTTC<br>GCAAGGTCTTTTGCAATGTCTAGCCAGATTATTCCATGTGAAAGAAT<br>TCTTAAAAGTGTGATGCGGTAGGAAGTTTTGCTCTACTACTGGTTAT<br>ACAGCAGCTTGAAACAAAACTTGGGAATTCTCATTTTTGGCTGGTTT<br>TGAAGCAATTTCAGATTGAAGGGAAATGCTGATTCATAGCAAAAAAA<br>AAA |
| 105 | ACACGAAAAACCAAAAGGTTGCTCTAACATTGAATGAAAATCCATTG<br>CTCAACTGCTCATTTAAATGAGGATGCATCACACTACTGTGCCTGAT<br>CTGTATCGGGAACCCATTTGAGTAGATTTGAAATATACATAACTAAC<br>CCATTTGAGTAGATTTGAAATATACATAACTAGCGACAAGTCAAATC<br>TCGTTATCTTCTGACCATCTTCTCGATTTCCCTGAAGGAAGCTTGGA<br>TTATGGCGACTCGGAAACGGACATTGCTGAAGGTCATCATTCTGGGC<br>GATAGCGGGGTGGGGAAAACATCACTAATGAATCAATATGTGAATAA<br>GAAATTCAGCAACCAATACAAGGCAACAATTGGAGCAGATTTCCTGA<br>CCAAAGAAGTGCAAGTGGAAGACAGACTTGTGACAATGCAGATCTGG<br>GATACAGCTGGGCAGGAGCGTTTTCAGAGTTTAGGTGTTGCCTTTTA<br>TCGGGGTGCAGACTGTTGTGTCCTTGTCTATGATGTGAATGTTATAA<br>AATCATTTGATAATCTGGACAACTGGCACCAGGAATTCCTTATACAG<br>GCAAATCCTAATGATCCAGATAATTTCCCATTTGTGGTATTGGGAAA<br>TAAAACTGATGTTGATGGTGGTCATAGCAGAGTAGTGTCTGAGAAGA<br>AGGCAAAGATGTGGTGTGCAGCCAAAGGAAACATTCCATATTTTGAA<br>ACATCAGCTAAAGAGGACATGAATGTGGAGGAAGCTTTTCAGTGCAT<br>TGCTAAGAATGCATTAAAAAATGAGCCAGATGAGGAAATTTATCTGC<br>CAGAGACTATAGATGTGGGTCACATCGGTGTACAGAGGCCATCTGCA<br>TGCCAGTGTTGAAGATCCATGAGTAAATGAGGTAAATATGGACAAGG<br>TGCCAGATAATTTTTACATGTCTAGCTGGTTGGTAACAATGGTATTA<br>TTCTTGTACCAGAATGTGAAATTTTTGGTAATTCTTGATTCAAGAAT<br>CAGATTGGAGAAACTTATATATGGTTTGGATTCTGGAATATTCATTA<br>TAATGGGACCTATGCACTAAGATTGAATATTCCCCTTCAAGAGAGTT<br>AAGGGATGCCTACAGTAAGTTTCTTGTGGTGAGCTAAAACGAAGTTG<br>TAACTGCAGTCTTCAGAAAAGGCTGTATCAATCCGGTCTTAACCAGA<br>CAGCTCAAAAGTGTCTGAATTAGCTTGTGTTTATTCATGCTCTCTGT<br>ATTCGTATTTTCCAATGCATTATATATGCTCTCTTGTAATAGCTACC<br>CTGCTTTCACTTGGATACTGTTCGCTGTTAATGCTTGAAATTTAATA<br>TAAATTTCTCACCTCTGTTTGTCCATGACTCCAAAAAAAAAA |
| 106 | GGTTGCTCTAACATTGAATGAAAATCCATTGCTCAACTGCTCATTTA<br>AATGAGGATGCATCACACTACTGTGCCTGATCTGTATCGGGAACCCA<br>TTTGAGTAGATTTGAAATATACATAACTAGCGACAAGTCAAATCTCG<br>TTATCTTCTGACCATCTTCTCGATTTCCCTGAAGATACTGGTCTGAA<br>ATTGAAGGAAGCTTGGATTATGGCGACTCGGAAACGGACATTGCTG<br>AAGGTCATCATTCTGGGCGATAGCGGGGTGGGGAAAACATCACTAAT<br>GAATCAATATGTGAATAAGAAATTCAGCAACCAATACAAGGCAACAA<br>TTGGAGCAGATTTCCTGACCAAAGAAGTGCAAGTGGAAGACAGACTT<br>GTGACAATGCAGATCTGGGATACAGCTGGGCAGGAGCGTTTTCAGAG<br>TTTAGGTGTTGCCTTTTATCGGGGTGCAGACTGTTGTGTCCTTGTCT<br>ATGATGTGAATGTTATAAAATCATTTGATAATCTGGACAACTGGCGC<br>CAGGAATTCCTTATACAGGCAAATCCTAATGATCCAGATAATTTCCC<br>ATTTGTGGTATTGGGAAATAAAACTGATGTTGATGGTGGTCATAGCA<br>GAGTAGTGTCTGAGAAGAAGGCAAAGATGTGGTGTGCAGCCAAAGGA<br>AACATTCCATATTTTGAAACATCAGCTAAAGAGGACATGAATGTGGA<br>GGAAGCTTTTCAGTGCATTGCTAAGAATGCATTAAAAAATGAGCCAG<br>ATGAGGAAATTTATCTGCCAGAGACTATAGATGTGGGTCACATCGGT<br>GTACAGAGGCCATCTGCATGCCAGTGTTGAAGATCCATGAGTAAATG<br>AGGTGCCAGATAATTTTTACATGTCTAGCTGGTTGGTAACAATGGTA<br>TTATTCTTGTACCAGAATGTGAAATTTTTGGTAATTCTTGATTCAAG<br>AATCAGATTGGAGAAACTTATATATGGTTTGGATTCGGAATATTCA<br>TTATAATGGGCCCTATGCACTAAGATTGAATATTCCCCTTCAAGAGA<br>GTTAAGGGATGCCTCCAGTAAGTTTTTTGTGGTGAGCTAAAACGAAG<br>TTGTAACTGCAGTCTTCAGAAAAGGCTGTATCAATCCGGTTTTACCC<br>AGACAGCTCAAAAGTGTCTGAATTAGCTTGTGTTTATTCATGCTCTC<br>GGTATTCGTATTTTCCAAATGCATAATATATGCTCTCTTGTAATAGC<br>TACCCTGCTTTCACTTGGATACTGTTCGCTGTTAATGCTTGAAATTT<br>AATATAAATTTCTCCCCTCTGTTTGTCCAAAAAAAAAA |

TABLE 2-continued

Cell Signaling Gene Sequences

| SEQ ID NO | Sequence |
|---|---|
| 107 | GCAATATTTTAAAAAAGATGAACAGTGAGATAAAATGAATAATTGCT<br>TCTCATGAATCCGAGCAGCTGAATTGTGCAAGGGACATGTGCTTGCT<br>CAATATAATTTTATTATTGTTCTTCCATAAAGGCTCTCACGAGCCAA<br>AAGAAACACGAAAAACCAAAAGGTTGCTCTAACATTGAATGAAAATC<br>CATTGCTCAACTGCTCATTTAAATGAGGATGCATCACACTACTGTGC<br>CTGATCTGTATCGGGAACCCATTTGAGTAGATTTGAAATATACATAA<br>CTAACCCATTTGAGTAGATTTGAAATATACATAACTAGCGACAAGTC<br>AAATCTCGTTATCTTCTGACCATCTTCTCGATTTCCCTGAAGGTTCT<br>CGCATTTTCTTCTTCTCTAGGATCATTTATTAACTCAGTTGTCATCC<br>ACATTTGATTGCTGATACTGTGCATGGTTCTGAGAATCTCAGAATTG<br>ACAATTGGGTATGTATATACTGGTCTGAAATTGAAGGAAGCTTGGAT<br>TATGGCGACTCGGAAACGGACATTGCTGAAGGTCATCATTCTGGGCG<br>ATAGCGGGGTGGGGAAAACATCACTAATGAATCAATATGTGAATAAG<br>AAATTCAGCAACCAATACAAGGCAACAATTGGAGCAGATTTCCTGAC<br>CAAAGAAGTGCAAGTGGAAGACAGACTTGTGACAATGCAGATCTGGG<br>ATACAGCTGGGCAGGAGCGTTTTCAGAGTTTAGGTGTTGCCTTTTAT<br>CGGGGTGCAGACTGTTGTGTCCTTGTCTATGATGTGAATGTTATAAA<br>ATCATTTGATAATCTGGACAACTGGCGCCAGGAATTCCTTATACAGG<br>CAAATCCTAATGATCCAGATAATTTCCCATTTGTGGTATTGGGAAAT<br>AAAACTGATGTTGATGGTGGTCATAGCAGAGTAGTGTCTGAGAAGAA<br>GGCAAAGATGTGGTGTGCAGCCAAAGGAAACATTCCATATTTTGAAA<br>CATCAGCTAAAGAGGACATGAATGTGGAGGAAGCTTTTCAGTGCATT<br>GCTAAGAATGCATTAAAAAATGAGCCAGATGAGGAAATTTATCTGCC<br>AGAGACTATAGATGTGGGTCACATCGGTGTACAGAGGCCATCTGCAT<br>GCCAGTGTTGAAGATCCATGAGTAAATGAGGTAAATATGGACAAGGT<br>GCCAGATAATTTTTACATGTCTAGCTGGTTGGTAACAATGGTATTAT<br>TCTTGTACCAGAATGTGAAATTTTTGGTAATTCTTGATTCAAGAATC<br>AGATTGGAGAAACTTATATATGGTTTGGATTCTGGAATATTCATTAT<br>AATGGGACCTATGCACTAAGATTGAATATTCCCCTTCAAGAGAGTTA<br>AGGGATGCCTACAGTAAGTTTCTTGTGGTGAGCTAAAACGAAGTTGT<br>AACTGCAGTCTTCAGAAAAGGCTGTATCAATCCGGTCTTAACCAGAC<br>AGCTCAAAAGTGTCTGAATTAGCTTGTGTTTATTCATGCTCTCTGTA<br>TTCGTATTTTCCAATGCATTATATATGCTCTCTTGTAATAGCTACCC<br>TGCTTTCACTTGGATACTGTTCGCTGTTAAATGCTTGAAATTTAATA<br>TAAATTTCTCACCTCGGTTTGTCCAAAAGAAAAAAAAAAAA |
| 108 | GGCGATACGAGGCAGCCAGCTTTTTACACCTGTTGATTGGAGAGCCC<br>AAACAGAAAATAGCCAAACACCCGATGCATTCGCAGGTCGTGGGGAA<br>TTCGTGAGTGGAGGAAATCGATCCACTCTCTATATGTAAATCGCTAT<br>CACACACATCGCACTCTGCGAAAAAGGGAGAATTTTTTCCTTCAAA<br>ACGAGATGAAGATGGGTTAAAACGGTGGTATGTGGGCCGATCTATAG<br>CAGAAACTCTGTAAAAACCCTATTGAATTTCAATGGGGCAGGGCGCC<br>TCGTCTTCTTCCGTGGTACATGCCTTAAAACGCGAAGAAAACGATGT<br>GAATTTGGGCAGAGATTACAGCCTGAGCCTTCCGGATGAATGCCTGG<br>CCTGCATCTTCTGCACTCTGAGCTCCGGCGACCGACAGCGATGCTCT<br>CTGGTGTGCAAGAGATGGTTTCTTGTCGAGGGTTCGAGTCGCCAGCG<br>GCTATCCTTGGATGCCCGGTTGGATATCTCAGCGGCAATCCCAGGCC<br>TCTTCAGCAGGTTCGATCATGTGACCAAGCTCGCTCTCAGGTGCGAT<br>CGCAGAATGGTAAGTATAAAAGACGAGGGCTTGATTAAAATTGGAAT<br>TCATTGTAAGAGCCTTAAAAAGTTGAAATTGAAGGCCTGTAGGGAGT<br>TATCTGATGTGGGTATCGAGGATTTTGCTAAGCTGTGTACTGGTCTG<br>AAAAAATTGTCGTGTGGGTCTTGTACTTTTGGGGCAAAGGGGATGAA<br>TGCTGTTCTTAAGTATTGTGTAGGGTTAGAGGAGTTGTCTGTTAAGC<br>GGTTGAGGGGTTTAGCTGACGGGAGTGTCGATGTTATCGGCCCCGGG<br>TGTGCGATGTTGAAGAGTATTTGCCTGAAGGAACTTTTTAACGGGCA<br>GTATTTTGGACCCCTGATTGCTGGATCGAAGAACCTGCGTACCCTCA<br>AGCTGTTTCGATGTTCAGGGGATTGGGATAAGCTGCTTGAGGTGATC<br>ACTGATCATGTGAGTGGATTGGTTGAGGTGCATCTCGAGAGGTTGCA<br>GGTAAGCGATCGGGGCCTGATGGCCGTTTCGAGGTGCGCAGGATTGG<br>AGGTCTTGCATCTGGTGAAGACTCCGGAGTGCACGAACGTCGGGCTT<br>GCGGCGATCGCCAACAACTGCAAAAATCTACGGAAGTTGCATATAGA<br>TGGTTGGAAAACGAATCGTATAGGCGATGAGGGGCTTATTGCCGTGG<br>GGAAAAAGTGTCAAAATTTGCAGGAGTTGGTGTTGATTGGCTTGAAT<br>CTGACTGCAACGAGCTTGAGTCCTCTGGCTTCCAATTGCCAGGTCTT<br>GGAGAGGTTGGCTCTCTGTGGCAGTGAGACGATCGGGGATACGGAGA<br>TCTCTTGTATCGCTGCGAAATGTCTTTCTTTGAAGAAGCTGTCCATC<br>AAGGGTTGTCCAGTTTCGGATGATGGGATCGAGTCCTTGGTCAGTGG<br>GTGTCCAAAGTTGGTGAAGGTGAAGGTGAAGAAATGCAGAGGGGTTA<br>CTTGGGAGGGCGCGGAACGGTTGAGGGCGAATAGAGGATCTTTTGGCT<br>GTTAACTTGGATACGCCGTTGCCGAATCCAGTTGTTGGTCCACCTTC<br>GGGAGCTGGTGCCGCTGAAGCTAGTGCCCCTTCAACCAGCAAATCAT<br>CAATAGCCAAGGCAAAGTTTTCTCTCTTTGCTGGAAGAAACCTTGTG<br>GCCTGTGCTTTTCTGAGATTGTCAAATGGATCCGATGGAGATCATAA |

TABLE 2-continued

Cell Signaling Gene Sequences

| SEQ ID NO | Sequence |
|---|---|
| | ACGAGTGTCTGCAAATGCATGAGTTGTTTATCCTATTGGAAAAACAA<br>GGCCAAGTCATGTTATTAAGCTCTGCTGGAGTTGCTTTACTGCTCAT<br>GGATCTTTTGGCATAGTGTTTCCTGATGCACGGTGCAGATATATGAC<br>TTGGCATCTAGATCAGGTAATACTAATAATGGAGCAGGAAAACATTG<br>TTTGCAATGGGCTATTTGCGTTAAGGTTTTCTTGTGTGCTAAGCAGT<br>TAGTCAATCTGGCTGTTGAACATGTTCTTCCAAAGAACATAAACCGC<br>TTGTATGCGGTGGACATCCGATGTTTGGCTTTGTCTTATTGGATGCG<br>TCGTGGAGTTAGTTCCTTTGTCCATTGAACAATCTTCCTTAAGGGAC<br>TGAGTTGACTTGTTTGCAATGGAATGTGCACAGCCAGGCTTTCAGAT<br>GAAAGCTCTGTCGGCTGTACAGGTAGGTAGTTTCTGGACAAAGTAGA<br>TCTCTGGGTTGTCAGCTTGAGATTCTAAGTGCAATGCAAGAGAATCT<br>GTGAAGGGATGGAATTAATTTGTGCAATGTTGGCAAAATAATCAATA<br>TGCATTTGTCATACATAATGTCTAAAAGAGCTCTCGTTTCTGATAGA<br>AACAGTATATTTGAAATGGGTATGTGTGCAGCGGCCAGCCACACTTT<br>CAGATGAATCTTTCTTTGTTATACCAGTAAACAGGTATTAAGTCTAG<br>TGAAAAAGGAGATCACCAGATTTTTGTCAAATGTTTAATTAAGTCGT<br>TTGCTGTAAGTTCTTCAGTAGATCCAATATAATCTGCACAAGGTTGG<br>AATTAAAAAAAAAA |
| 109 | GAGTTGTCCCAGTTGGGTACACAGCCAACTCCAGCTAACGCGCAGTC<br>CCTGCTAGGTGCCTACCGGATGCTGCTGACTCTGCCGTCAATTTCCC<br>TTTTATTATATACCACTTTATTGCTTCGCAAGATTCAGCCAAGTGGA<br>TCTGGCTACAGATTTTCTCATCTCCAAGGCTGCCAGAACTCAAATCT<br>GATCGCACACGACTCTCTCCTTTGGTCATTTTTGGGGCTTTTGGGTG<br>TTTATTGCGGACACCCAATGCCCAAAGATCTGGATCCAATACCCATT<br>TCCTAGATCAGCGTAAACAACGCGTCGGTTTGATATTCAGCGTGTAT<br>CCGTCCATTCAACGGGAGATTGGGTTTCTGCGATACATTCGTTGTGT<br>ATCCATCCAACAGTTATTGGGCGTCTGCAGTAGGTTGATATTCATTA<br>TCTATCCCTTGAACTAGCTATTGGGTTCCCGCAATAAGCCGATATTC<br>ATCGTGTATCCATTGAAAGGCTATTATTTTTCTGCAATAGCTTGATA<br>TCCATTGTGTATTCATCCAGCCAGATATTGGATGTCTATATTAGGCC<br>GATATTCATTATCTACCCATTGAACCGGCTATTGGGTTTCTGCTATA<br>AGGTGAAATTAACTGTGCAGCTATTCATTCAGGTTTTGGATTCTTGA<br>GCACACCCAAGAGTTCGTTTGGTGTTGTGTGGAGATGGCTTACAAAG<br>TCGATGATGATTATGACTATTTGTTTAAGGTGGTCCTGATTGGGGAT<br>TCTGGTGTCGGTAAGTCCAATTTGCTCTCCAGATTTACTAGAAATGA<br>ATTCAGCCTGGAGTCCAAATCTACAATTGGTGTGGAGTTTGCAACAC<br>GGAGTATTAATGTTGATGGGAAAATGATCAAGGCCCAGATATGGGAC<br>ACTGCTGGTCAGGAAAGGTACAGAGCCATCACAAGTGCATATTATCG<br>CGGTGCTGTTGGTGCGTTGTTGGTTTACGACATCACTCGACATGTCA<br>CCTTCGAAAATGTTGAGAGGTGGCTCAAGGAGCTTCGTGATCATACC<br>GAGCACAACATTGTGGTGATGCTTGTTGGTAACAAGTCCGACTTGCG<br>CCATTTGAGGGCTGTTTCCACAGAAGATGCCCAGACCTTTGCAGAAA<br>GAGAAGGGCTCTATTTCATAGAGACATCTGCACTAGAGTCCACCAAT<br>GTGGAAAATGCTTTCAAGCAGGTGCTGACTCAAATATACAGGATCGT<br>TAGTAAGAAGGCCCTGGATGTTTCGGAAGATAATGCAGCAGCTCCCG<br>CACAAGGTCAAACAATAAACGTGAAAGATGATGTCACGGCAACTAAG<br>AAAGTTGGTTGCTGTAGCACATCATAAGCAGCAGGTGAAATCCCTCA<br>GGATTCGGATTTCAGTTCAGATGCAGGACTATTATGTTCATTGGAAA<br>AACTTTGACCGATTTCTGGAATCACTTATAGTTGAATTCGAGCAGGT<br>TCTCATTTGGTATGATTTTAAGAGGCTTCAAAGTTGGACTCACTTAG<br>TAACTAGTTTTAGACGGAGAGAAGAGTGTTGTAGCCAATGGTGGGTA<br>ATCTGAATTGTATATCTTATTCTTGCTGTATTCTCTGCAACTTCTAG<br>TGTCCCAGTACTATCTTTGTTCTAGTCAGTGCTTCAGTTTTACATG<br>CCATCATTTGTATCCATTATTTGATTTTATTCTCACAGTGGAACAGA<br>TTTTTTTTGATCTTAGTTAATATTAAAAAAAAAAAAAAA |
| 110 | ATAATACCCGATGCCAATTGTTTATAGCACAGAGTGCTCTTCTTCCA<br>CTGCTCTCTAGCTCTCGTGGCACACAAGGAGGAGTTTCAGAGAGGCC<br>AGGCCAGTCTGCGGATCTGTGTTCAGACAAGATGAGTAGCGACAAGG<br>AGAGGGAGAATCATGTTTACATGGCCAAACTCGCTGAGCAGGCCGAG<br>CGATACGATGAAATGGTTGAAGCCATGAAGAGGGTCGCGAAGCTGGA<br>CGTGGAGTTAACTGTAGAAGAAAGGAATCTTCTCTCTGTTGGGTACA<br>AAAATGTGATTGGGGCTCGGCGAGCTTCCTGGAGAATAATGTCCTCT<br>ATTGAGCAGAAGGAGGACGCGAAGGGCAATGATCATAACGTGAAACG<br>TATCAAAGAGTATAGACAGAAAGTTGAAGCAGAGCTTTCTAAGATTT<br>GCCATGATATTATGACCATAATTGATGAACACCTTATTCCTTCCTCC<br>AATATTGGCGAATCTACTGTTTTCTACTATAAAATGAAAGGAGACTA<br>CTACCGTTATCTGGCTGAATTCAAAACAGGAAATGAGAGAAAAGAAG<br>CCGCTGATCAGTCCTTGAAAGCTTACCAGACAGCTTCAAGTACTGCA<br>GAGTCGGATTTAGCGCCAACTCATCCAATCAGACTTGGATTGGCCTT<br>GAACTTTTCTGTTTTCTATTATGAAATAATGAATTCACCTGAAAGGG<br>CTTGTCATCTGGCCAAGCAAGCTTTTGATGAAGCTATTGCAGAACTT |

TABLE 2-continued

Cell Signaling Gene Sequences

| SEQ ID NO | Sequence |
|---|---|
| | GACACCTTGAGTGAAGAGTCATACAAAGATAGCACTTTAATCATGCA<br>GCTCTTGAGGGATAATCTTACTTTGTGGACCTCTGATCTCCAGGAAG<br>ATGGAGTTGAGGATCAGACCAAGGGGGATGAGCCTGTAGTTGGGATG<br>GATGAAGAGCTTTGAGCAGGTACATGTAGAAACAAATGAAGTTGTTA<br>GATATGGGCTTTTATGTCGGCCTCAATGTACTCTAGAGTACTCCTTT<br>CTGCTCTGCAGCTGCAATTTACAAATTCGCTCTATTTATCTTGTTAT<br>TGACACCTGGTTTTGTTTATAAGTTTTAGATTGGAACAAAAGACCAG<br>TAGGACATTATGGGGTCTTAACTTGGTGTGTATACCATGGCTATTAA<br>ATGCTTCAATATGTAATAGGGGCCCAGCACTGCAGTACTGTGTAGAA<br>TTTAGAGTCTTTCGTTGTGCATTATTATCGTTTTGAAGATTAATATA<br>GGCTTTTGATGGATGAAGTGGCTTTGTTGCCACAAAGGAGCTGAATT<br>CTTTGAGCTTTCCTCGTTTTCTTTTTTCAAAATTTCTGGAAGTTATA<br>TCGAATCTAACTTAATAAAAA |
| 111 | AGAGTGCTCTTCTTCCACTGCTCTCTAGCTCTCGTGGCACACAAGGA<br>GGAGTTTCAGAGAGGCCAGGCCAGTCTGCGGATCTGTGTTCAGACAA<br>GATGAGTAGCGACAAGGAGAGGGAGAATCATGTTTACATGGCCAAAC<br>TCGCTGAGCAGGCCGAGCGATACGATGAAATGGTTGAAGCCATGAAG<br>AGGGTCGCGAAGCTGGACGTGGAGTTAACTGTAGAAGAAAGGAATCT<br>TCTCTCTGTTGGGTACAAAAATGTGATTGGGGCTCGGCGAGCTTCCT<br>GGAGAATAATGTCCTCTATTGAGCAGAAGGAGGACGCGAAGGGCAAT<br>GATCATAACGTGAAACGTATCAAAGAGTATAGACAGAAAGTTGAAGC<br>AGAGCTTTCTAAGATTTGCCATGATATTATGACCATAATTGATGAAC<br>ACCTTATTCCTTCCTCCAATATTGGCGAATCTACTGTTTTCTACTAT<br>AAAATGAAAGGAGACTACTACCGTTATCTGGCTGAATTCAAAACAGG<br>AAATGAGAGAAAAGAAGCCGCTGATCAGTCCTTGAAAGCTTACCAGA<br>CAGCTTCAAGTACTGCAGAGTCGGATTTAGCGCCAACTCATCCAATC<br>AGACTTGGATTGGCCTTGAACTTTTCTGTTTTCTATTATGAAATAAT<br>GAATTCACCTGAAAGGGCTTGTCATCTGGCCAAGCAAGCTTTTGATG<br>AAGCTATTGCAGAACTTGACACCTTGAGTGAAGAGTCATACAAAGAT<br>AGCACTTTAATCATGCAGCTCTTGAGGGATAATCTTACTTTGTGGAC<br>CTCTGATCTCCAGGAAGATGGAGTTGAGGATCAGACCAAGGGGGATG<br>AGCCTGTAGTTGGGATGGATGAAGAGCTTTGAGCAGGTACATGTAGA<br>AACAAATGAAGTTGTTAGATATGGGCTTTTATGTCGGCCTCAATGTA<br>CTCTAGAGTACTCCTTTCTGCTCTGCAGCTGCAATTTACAAATTCGC<br>TCTATTTATCTTGTTATTGACACCTGGTTTTGTTTATAAGTTTTAGA<br>TTGGAACAAAAGACCAGTAGGACATTATGGGGTCTTAACTTGGTGTG<br>TATACCATGGCTATTAAATGCTTCAATATGTAATAGGGGCCCAGCAC<br>TGCAGTACTGTGTAGAATTTAGAGTCTTTCGTTGTGCATTATTATCG<br>TTTTGAAGATTAATATAGGCTTTTGATGGATGAAGTGGCTTTGTTGC<br>CACAAAAAAAAA |
| 112 | CAGAGCTCCTATAACCCCCAATTGTGTCTCCATTTTTGCGTGCGAAC<br>CATGGCTCAAGCTCCCAAAAATCTGTGTATCATTCTGTTCTTCATCA<br>CAAGTTCCTTGTACTGCCCTTCATTGTCTTGCGCTGCTGCTTTCACA<br>GAAAATCCATTAACAGTTCTTGGTTCTGCCAGTTTAGTGTGTTTGTG<br>CATTGCAGCGGCCGTTTCTTTGAAGATCCAGAGGTGAAGTTGGGTTT<br>TTATTATTTGTGTACAAATGGCGGCAGCGGCGATGGTGGAGTCATCG<br>CGGGAGGAGAATGTCTACATGGCGAAGCTGGCCGAGCAGGCGGAGCG<br>CTACGAAGAGATGGTGGAGTTCATGGAGAAAGTGACAAAAGGCGTGG<br>AGGTGGAGGAGCTCACAGTGGAGGAGCGGAACCTGCTATCTGTAGCC<br>TACAAAAACGTGATCGGTGCCCGCAGGGCCTCCTGGAGGATTATCTC<br>CTCCATCGAGCAGAAGGAGGAGAGCAGGGGCAATGATGAGCACGTGG<br>TCACCATCAGGGAGTACAGAGCCAAGGTGGAAGCAGAGCTTTCCAAG<br>ATCTGTGAGGGCATTCTCCGCCTCCTCGACTCCCACCTCATCCCTTC<br>TTCCACCGCTGCGGAGTCCAAGGTTTTCTATCTCAAGATGAAGGGCG<br>ATTACCATCGATACCTTGCCGAGTTTAAGACAGGCGCCGAGAGGAAG<br>GAGGCCGCTGAGAACACTCTGCTTGCTTACAAGTCTGCGCAGGATAT<br>TGCTGCGGCAGAGCTGGCTCCAACGCATCCTATTAGGCTAGGGCTGG<br>CTCTTAACTTCTCTGTATTTTACTATGAGATTTTGAATTCGCCAGAC<br>AGAGCCTGTAATCTCGCAAAACAGGCATTTGATGAGGCAATTGCGGA<br>GTTAGATACCTTAGGTGAAGATTCTTACAAGGACAGCACTCTCATCA<br>TGCAGCTCCTTCGTGACAATTTGACATTGTGGACCTCAGACATGCAG<br>GAGGATGCTGGGGAAGAGATCAAAGAGACTTCTAAGCGTGAGGACGG<br>GGAGGAGCAATAGTGAAATGTGATAATCTTATAGTGTATTAGGATTA<br>GGATTAGATTACCAGGCTTTCCTGCATTGTTTGGTAAAGGAGGCCTA<br>TGTGCACGATTGTGTTTATTAGATCTCATGCTCTGCAGCATTTAGTT<br>GCTGTGGGTAGCATATTCTTAGTCATATTTTGTTGGCTGCGTTTATG<br>TTGGCATTTTATATCATCTATTTGCGAATGGTTGGAGACAGTGGCTT<br>GGTACTGTAATATCAGATTGGTGGAGTCTATCAACAAATCTGTAGGC<br>CCATTCTGCTTTTGTGTTCAATAATATTTTTTATTGTCTTGATTTAA<br>AAAAAAAAAAAAAAAAAA |

TABLE 2-continued

Cell Signaling Gene Sequences

| SEQ ID NO | Sequence |
|---|---|
| 113 | GAGAACTAAAACCAATAAAACTTGAAGCTTTAAAAGGGAACAGGTCG<br>AGGACGAAGCCGAGTCTTGTCCGTGAACAATGAATAAGAAACCAGAT<br>GCTTGTAGGTTATACGCCAGTCCTTAGAATTATTATCCCTACGATCG<br>TGGGAAAGCTTTTCGTTCTAGCCTGGAGGAGGAGAAGTCAAGTTATC<br>GTTGCTATGTCCCACGAGATTGAACACATCGCCTTGTCGCTAGAGAT<br>TTTGGCGGTGTAGAGCCCTTTTTCCAGTCCACTCTGGTCTTATCAAT<br>TTCCATTTCTCTCTTTATCGATATTAAACGGAAGGCCACGGTATCCT<br>CTCTTATTGAATTTCTCCGAAAATCCGGATAAGCAAATCCGGATAA<br>AGAGCGATTCAATCATCATCCAATTGCGGCTGATAACCCAGCAGGAC<br>TAGGCTGGATTCAAACCTCAACAGAACCAGACTCTAAAACCTGGAGG<br>CGAACTCCACTTTGAAACAGAGTTTGAACCCATGGAGCGCTAGTGGA<br>CTGTTTATCTATATGTAAATGTAATTATCAGGATTGGAACCTCAGTT<br>GGACCAGAATCTGAAACCTTGTGATGAACTTTGCCTCGAAACAGTCG<br>ATTTGAATCCGTTGATCTAACCTTAATAGGCTATTTGTCTATATACA<br>ATTATCAGAAGTCCTGATTAAAGAGAAATGGATGGAATGTCTACTCG<br>AGGTGGCAGCAATTTTGATATGTATTTGCCTAATTATAAGCTCGGAA<br>AGACGCTAGGGATTGGCTCGTTTGGCAAAGTGAAGATTGCAGAACAT<br>GCATTAACAGGACACAAAGTGGCAATAAAGATACTTAATCGCAGGAA<br>GATTAGAAACATGGATATGGAGGAAAAAGTGAGGCGGGAAATCAAAA<br>TATTAAGATTATTTATGCACCCTCATATCATACGTCTCTATGAGGTT<br>ATAGAAACTCCATCAGATATATATGTTGTGATGGAATATGTAAAGTC<br>TGGGGACCTCTTTGATTATATTGTTGAGAAAGGTCGATTGCAAGAGG<br>ACGAGGCCCGATGCTTTTCCAGCAGATTATATCAGGCGTGGAGTAT<br>TGCCACAGAAATATGATTGTTCATCGTGATCTTAAGCCCGAAAACTT<br>ATTGCTAGATTCCAAATGCAATGTTAAGATTGCAGACTTTGGGCTTA<br>GTAATGTTATGCGCGATGGACATTTTCTTAAAACAAGCTGCGGCAGT<br>CCAAATTATGCTGCCCCCGAGGTAATATCAGGTAAATTATATGCAGG<br>GCCAGAGGTAGATGTTTGGAGTTGCGGAGTTATATTATATGCACTTC<br>TTTGTGGAAGTTTGCCATTTGATGATGAAAACATTCCAAATCTCTTC<br>AAGAAAATAAAGGGTGGAATATACACACTTCCGAGTCATTTGTCATC<br>TGGAGCAAGGGATTTGATCCCAAGGATGCTTGTTGTCGATCCCATGA<br>AAAGGATGACCATTCCAGAGATTCGTCAGCATCCCTGGTTTCTAGAG<br>AAACTTCCACGCTATTTGGCAGTTCCCCCACCTGATACAATTCAACA<br>AGCAAAAAAGATTGATGAAGAAATTCTTCAGGAGGTGATTAAAAGGA<br>ATTTTGACAGGAACCAGTTGGTAGAATCCCTTCGAAGCAGAATACAG<br>AATGAGGCTACAGTTGCATATTATTTGATGCTGGATAATCGGAGCCG<br>TATCTCCAATGGTTATCTTGGCTCTGAGTTTCAAGAAGCAAAGGATT<br>GCATACATCACTTTGTACCAACTGATCGTGCAACACCAACTGGTGAT<br>CACAGATTAACTGGTTTTATTAATCAGGGAAATGCCTCAAGATCCCA<br>ATTTCCTATTGAGAGGAAATGGGCTCTAGGACTTCAGTCTCAGGCTC<br>ATCCTCGTGAGATTATGTCAGAGGTTCTAAAGGCACTTCAAGAGCTG<br>GATGTCGCATGGAAAAAGATAGGACACTACAATATGAAATGTAGATG<br>GTTTCCTGCTGTATTAAGGAAAGTTGATTCTTCAATGAATAAATCTT<br>TGCATGGAAACCATATTATTCAAGACGACTCTACAGCTGGCATCAAC<br>TGTAGATCTCCGCCAAATGTGGTCAAGTTCGAAGTGCAGCTTTACAA<br>AGCCAGAGAGGAGAAATATCTTCTTGATCTTCAAAGGGTACAAGGGC<br>CACATTTCCTCTTTCTTGACCTCTGTGCAGATTTTCTTGCACAACTT<br>AGAGTTCTATGACATGAAAGACTTTTAGGAATATTTAAGGCTCAAGA<br>GATTCTAAGGAATATAATGGTAGTTTACCAGATTATATGGTTACTAT<br>CAACTGTTCGATTGTTCTAGTGTGCAGTAATGAAATATTTTGTATAG<br>TAGTATGCTCATCATATTCTGTTCTGAGGAGCTGAAAATGAGAGAAG<br>ATAAATGAATCACCAGTAATCCCCTTCTTGCTGTTGTTGCAACAAGG<br>TTTGGATTTTCATTATCCCCCAGACAGCTAAAAGTTATTTTTTTCTT<br>CGCAATTTATGCGATTTAAAGAAAGCTTTGTTTTTTACTCCAAAAAA<br>AAAAAAAAAAAAAAAAAA |
| 114 | GGTTGACAAGTCGGTGCACCTTACCCTTAACGTGCTTTGCCGAATAC<br>CATCGTAGTAGTAGAACTAGCCGGAGGAAGGGTCGGAAACTTATGGA<br>AGTTTAAGTTGTATTTAGAGAAAATTTGGCAAGGATTTTTGGATTTA<br>TAATGGTTAAATTTTAAACTTTTTAATTTTTGATGATGTTGAATCCA<br>TTTTCCACATGATACAAAAACTTTCTCTACCAAAATTTTGGAACTTT<br>TACCGGATTCCCGCCACTTTTGACGGTCTAGGCAATTCGTCTGCCTT<br>GTTAAACGACTTATTTACCATCTCCCAGGACGAGTGAGAAGGTTGTA<br>TATCTCCCATGAGAAGAAGGTTGTTGGAGTTCCAGTGCATGCACCTA<br>ACGTTAACCTGCGATTCCCTATTGTTTCCTATTTCCCAGGAGGAGTC<br>AGAAGGTTGTATATCTCCCAGAACTTAGAAGGAGAAGGTTGTTCGAG<br>CTCCAGTGCAACAACGATGACAATAGCCAGGAGATGTTCTTCACTTA<br>TAGTGCGAGGAGTGCGGTCTGCTGGTTCCCGTTCATCTGCTGTTGGA<br>TCGCCAGCTCTATCAAAACAAGCATCAACAAAGAATTCCAGAATTCA<br>AAGATTTGGAACAGCTGCAAGTGCTTTAGAGGAACCTATAGCACCAC<br>CTGTCCAAGTGAAGTACACGCATCTTCTTATTGATGGACAATTCGTT<br>AATGCAGCTTCTGGGAAAACATTTCCAACCTTTGATCCCAGAACAGG<br>GGATTTGATTGCTGATGTGGCTGAAGGCGATGCAGAAGATGTGGACA |

TABLE 2-continued

Cell Signaling Gene Sequences

| SEQ ID NO | Sequence |
|---|---|
|  | GAGCTGTAAAGGCTGCACGAAAAGCCTTTGATGAAGGCCCATGGCCA<br>AAAATGACTGCTTATGAAAGATCGTGTATTATGTACCGGTTTGCTGA<br>CTTGCTTGAAAAGCATAATGATGAGATTGCAGCTCTGGAAACATGGG<br>ACAATGGGAAGCCTTATGAGCAATCATCCTTGGTCGAAGTGCCAATG<br>GCAATACGGGTATTTCGTTACTATGCAGGTTGGGCAGATAAAATACA<br>TGGCCTTACAATTCCAGCTGATGGACCTTATCATGTTCAAACTTTAC<br>ATGAACCTATTGGAGTTGCAGGTCAAATCATTCCTTGGAATTTTCCA<br>TTGCTTTTGTTTTCTTGGAAAGTGGCTCCAGCACTAGCTTGTGGGAA<br>CACTATTGTATTAAAGAGTGCTGAGCAGACATCATTAACAGCTATTT<br>ATGCAGCAAAGCTTTTCCATGAGGCTGGACTGCCTTCAGGAGTCCTG<br>AATATCATTCCAGGATATGGTCGAACTGCAGGAGTTGCAATTGCAAA<br>ACACATGGATATTGATAAGCTTGCCTTCACAGGATCAACTGAAACTG<br>GTAAAGCAGTACTAGAGTTAGCTTCTAAGAGCAACCTTAAGCGAGTG<br>ACATTGGAACTTGGAGGGAAGTCTCCATTTATCGTATGTGAAGATGC<br>TGATGTTGACCAGGCTGTTGAGCTTGCACACTCTGCTCTATTTTTCA<br>ACCAGGGTCAATGCTGCTGTGCTGCATCACGAACCTATGTACATGAG<br>AGCATCTATGATGAATTTGTAGAAAAGACAAAAGCACGGTGTTTAAG<br>TCGTGTTGTTGGTGATCCCTTTAAAAAAGGCGTTGAACAAGGTCCTC<br>AGATTGACCAGATGCAGTTTAACAAAATTATGAGTTATATTAAGGCT<br>GGGAAAGAGAGTGGTGCAAAACTTGTAACAGGGGGAGAGCAAATTGG<br>TACCAAGGGCTTCTACATTATGCCCACAGTTTTCTCAGAAGTTCAGG<br>ATGACATGCCCATTGCCACTGATGAAATATTTGGCCCTATACAATCA<br>ATTTTGAAATTCAAAGATATAAACGAAGTAATAAAGCGGGCTAATGG<br>TACTGATTATGGCTTGGCAGCGGGAGTCTTTACAAAGAGTATGGATA<br>CCGCAAACACTCTCACTCGTGCGTTACGTGCAGGATCAATCTGGATT<br>AATTGCTTTCACATTTTTGATGCCGGTGTACCTTTTGGTGGCTATAA<br>AATGAGTGGCACCGGAAGACAAAAGGGAATATATGGTCTCCAAAGTT<br>ACTTACAGGTTAAAGCCGTTGTGACTCCTTTGAAGAATCCAGCATGG<br>TTGTAGGCTGTTACGTTCCTTCTAATATATTTGATGAATGCAGAACA<br>TATTTAATCCCTTGTGCTATTGTCAAGTCAGTCTACTTTGAAATAAA<br>CTCTCTATTACTAGAAATGTGTTACCTTCAGAGGGGTGGGATGGTTC<br>GTTTAGCTGGGCATCCTATAGTAACGTCTCTGTAAAACTGTGTAGAT<br>TCAGACGTTAGAACTCTGGTTAGCTGTGCATCCTATAGTAACGTCTC<br>TGTAATACGGTGTAGATTCAGACGTTGGAAATCAATTAT |
| 115 | GTTGGAGTTGCACACAAGGTTGGAGGAAGAAAGTTGTTGGAGCTCTC<br>AGGTTGAACGAAAATGGCAGCAATGCGAGCAGGCAGGGGATTTTCTT<br>CACTTCTAACTCGAGCAGTCCGGTCGGCTGGTACACGGTCACCCGCC<br>GTTGGATTGGCAGCTTTATCACAAGAAGCATCCATAAAGAATACTGG<br>GATTCGAAGTTTAGGAACAGCGGCAAGTGCTTTGGAAGAACCTATAG<br>CACCACCTGTCCAAGTACAGTATACACAGCTTCTTATCGATGGACAA<br>TTTGTTAATGCGGCTTCTGGAAGAACATTTCCAACATTGGATCCCAG<br>AACAGGGGATTTGATTGTCGATGTGGCTGAAGGTGATGCAGAAGACG<br>TGGACAGGGCTGTAAAGGCTGCACGAAAAGCCTTTGACGAGGGCCCA<br>TGGCCGAAAATGACTGCTTATGAGAGATCATGTATTATGCTCCGGTT<br>CGCTGACTTGCTTGAAAAGCATAATGACGAGATTGCAGCCTTGGAAA<br>ACATGGGACAATGGGAAGCCCTATGAGCAAGCAGCCTTGGTTGAAGT<br>GCCAATGGTAGTGCGGCTATTTCGTTACTATGCAGGGTGGGCAGATA<br>AAATACATGGCCTTACAGTTCCAGCTGATGGACCTTATCATTGTCAA<br>ACATTACATGAGCCTATTGGAGTTGCAGGTCAAATCATCCCTTGGAA<br>TTTTCCACTACTTATGTTTGCTTGGAAAGTTGGTCCTGCACTAGCTT<br>GTGGGAACAGTATTGTATTAAAGAGTGCTGAGCAGACACCATTAACA<br>GCTCTTTATGCAGCAAAACTTTTCCATGAGGCTGGACTGCCTCCAGG<br>AGTTCTGAATGTCATTTCAGGATATGGTCCAACTGCGGGAGCTGCAA<br>TTGCAAGACACATGGATATTGATAAGGTTGCTTTTACAGGTTCAACT<br>TCTACTGGTCAAGCAGTGCTAGAGTTAGCTTCCAAGAGCAACCTTAA<br>GCCAGTGACATTGGAACTTGGAGGAAAGTCCCCTTTTATTGTATGCA<br>AAGATGCTGATGTCGATCAAGCCGTGGAACTCGCTCACTTTGCATTA<br>TTTTTCAATCAGGGTCAATGCTGCTGTGCTGGATCACGAACCTTTGT<br>ACATGAGAGTATCCATGATGAGTTTGTAGAAAAAGCAAAAGCGCGGT<br>GTTTAAGTCGGGTTGTCGGTGATCCTTTTAGAAAAGGTGTTGAGCAG<br>GGTCCTCAGATTGATCGGGAACAGTTTAACAAGGTTATGGGTTATAT<br>CAAGTCTGGGAGGGAGAGTGGTGCAAAACTTGTAACAGGGGGAGACC<br>AAATTGGTACCAAGGGCTTCTATATTATGCCTACCATCTTCTCAGAA<br>GTTAAGGATGACATGGGCATAGCTACTGACGAAATATTTGGTCCAGT<br>ACAGTCAATTATAAAATTCAAAACTTTAGACGAAGTAATAAAGCGGG<br>CGAATGCTACTCGTTATGGCTTGGCAGCAGGAGTGTTTACAAAGAAT<br>ATAGAGACCGCGAACTCTCTTACTCGGGCATTACGTGTCGGAACAGT<br>TTGGGTTAATTGCTTTGACATTTTTGATGCTGGTATACCTTTTGGTG<br>GCTATAAAATGAGTGGCACTGGAAGAGAGAAGGGTATCTACAGTCTC<br>AATAACTACTTACAGGTTAAAGCTGTTGTCTCTCCTTTGAAGAATCC<br>AGCCTGGTTGTAGGCTGTTAGTTCCTACAAATGGTTCTATTGTGTGG<br>GGGAACATATTCAGTTCCTGATGGTCTTGTCAAGTCAGTCTAATTTG |

TABLE 2-continued

Cell Signaling Gene Sequences

| SEQ ID NO | Sequence |
|---|---|
| | AATTTAGCTTTCTCTGTCAATAATTAATGTATATGACCTTCAGAGAG<br>GTGTGATGCTCTTGTTTTCCTGTGAACCTTCACAGTTGTGTCTCTGT<br>AAGATTCTGTGGTTTCAGAATTTGGAACTCAATTATCATGGCCATAT<br>CAAATGCGAAATGAAGGGTGTCATTGTTTCTGCCAAAAAAAAAA |
| 116 | GCTCTTTTTAGAGCCTTGGGCAGCTTTTGGGGTGTTTTTTTTTTCT<br>GTGAGTGGAATTGAAGTAGAAGTTGAAGCTGAAGCTCCCCTGGATGC<br>TCCAGAGGCTTCACAAATATCTCAGTTTCTGAGGCTTCACAAATATC<br>TCAGTTTCTGGAATAGGTGGAAGAGATTGAGGTTGGTTGTTTGTATG<br>TATGTACAGTAGGCTTTTGGGTTTTTTTTTGGGTTTCTGGAGTGGCT<br>ATATGGATCATGAAGGCAGGGGAGGAAGTGGTTTATTGGCATGTTTT<br>GGGATCAGCCGCCATGAAGCTGGAGTGCATTAATGGCGGACTCGACA<br>AATTACTGCACCTTGGGATGGAGAAAAAGGGATTTGGGATATTTTGG<br>ACATAAGGGATTTTTTCAATAGAAATCCCGTGAAATCCCTTGAAATC<br>CCTTAAAACTCCTTGCTGATTATTTTTAGCAAATTCTCCGAGATCTC<br>GGATCTCGACTTTACAATTATGAAGCGACAACACTTTCAATTGCAGC<br>AGCAGCAGCAGCCGCAGCCGAACGGTCATGGCCGCTGCTGCAGCACT<br>GTTCCGGTCCATCCCAACCCGGTGTCCATGCCAGGGTCCGGGCCACC<br>ACCACAAGCACCAAGAACAACAGCAACAGCGCCTGCAGCGGGAGCGG<br>CAGCAGCAGGGGGAGGTGGAAGTTCAGGGTCTTGCAAGGGCAAGGAA<br>GTGGTATTGAAGGATACTTGTAAGCAGGGTGTAGGTGTGGATATGGA<br>ACTGGCTTCCATGGGTTACAGTGTGAAATCCTCTGAACTGGAACAAG<br>TGGCACACAGGCTTGAGCAGCTGGAGATGATGATGTGCAACGGGCAA<br>GAGGATGGCATCATTTCCCACTTGTCGTCAGAGGCTGTGCACTATAA<br>TCCCTCGGACCTCGGTGGATGGATTGAAAGTATGCTCAGCGAGCTTC<br>ATGTCCCTATTCTTCCTCCAACAGATCAGCCGTTTCAGTTCCCTCAG<br>GCAGCAGCGGATCAATCCTCTACGGTTCGGGAAGCGAGCAATTCGGT<br>GCCGGAATCATCCACTTCGACTTCGAAGGGCACCAGATCTGTGCAGA<br>ATGTTGAACAGGACCAACAGTACAGATTAAATGGGTCCGGGGCCGGG<br>TTGTTTGAGCCGCCTGAGGTCCTGGATCGATCAGAATTCCAGCTTCA<br>TGGCTATCCGGGCCAAGGGGGAGTACGAGATAATGGGATTGATCGCA<br>TGTTCGGTAACTATGGCGGCCTTTTTTCTCAAGTATTAGACGTCTCG<br>GACCTGCTAGTCGATGACCCTGATGTTCTACAGGAACCACCACCACA<br>GGAGGCTTCGCCCTCAACTCTGCTGCTGCAGAGCTCCAGCAACTCTT<br>CGCTTGAAGTCCAATCCGGGCAAGACCGTCTGGAAGAGGATGTTACG<br>GGAAGAGAGCAAAAGCGTTACCGTGTCTGCGACCCGGAGCTTTCGGA<br>GCGAACCGTGGTAGTAATGGGGGCAGACCCGCACGAATCCGGAGTCC<br>GTCTCGTGCACACGCTGATGGCCTGCGCAGAAGCGGTGCAGCGCGGT<br>AATTTGGCCATCGCGCGGGAAATGGTGAAAGAAGTGAGAATTCTGGC<br>TTCAGCACAGGGCGGGGCAATGAGCAAGGTCGCCACATATTTTGCCG<br>AGGCTCTTGCCCGGCGAATCTATGGGTTTCTCCCTCAGGACACCTTG<br>CGGTTCAACCAGAACGACCCCTTGTCCGATTTTCTGCAATTTCATTT<br>CTACCAAACCTGCCCCTATCTCAAATTCGCGCACTTCATAGCCAACC<br>AGGCCATTCTGGATGCCTTCTCCGGGCACCAACAGGTTCATGTCATA<br>GATTTCAATCTGAAACAGGGGATCCAGTGGCCGGCCTTGATACAGGC<br>ACTGGCTCTTCGCCCCGGCGGGCCACCGGCTTTCAGGCTAACCGGAA<br>TCGGCCCACCCCAACCCGACGGAACCGATGCATTGCAGGAGGTCGGC<br>ACGAGGCTCCACCAATTTGCAGAGTCCGTCAATGTAAAATTCTCCTT<br>CCGTGGCTATGTTGCCACAAGCCTCGCCGACATCAAGCCATGGATGC<br>TCGACGCCCGGCCCGAGCTCGAGGCTGTTGCAGTGAATTCTATCCTT<br>GAGCTCCATCGTCTCCTGGAGGACCCCATCCCCGGACGACCCAGTGC<br>CATCGATCGAGTACTCGCTTCCATCGGAGCCTGAAGCCCAAGATCT<br>TGACAGTGGTTGAACAGGAGGCCGACCACAACCGCCCTGTTTTCTTG<br>GATCGATTCACAGAGGCACTGCATTATTATTCCACAGTTTTTGATTC<br>CCTGGAGGCGCGCGGGTTGCAGGCCCAGAGCGAAGAGCAGGTGATGT<br>CGGAAGTCTATCTGGGTCGAGAAATTTGCAACATTGTAGCCTGTGAG<br>CGATCGGAACGGGTGGAAAGGCACGAACCTCTCTTGAATTGGAGCGT<br>TCGCTTGAGAAACGCTGGCTTCTGGCCTATTCCTTTGGGATCCAATG<br>CTTTCAAGCAGGCCAGCATGTTGCTCAGTCTCTTCTCAGGTGGAGAA<br>GGATATAGGGTTGAGGAGAATAATGGGTGTCTAACACTTGGTTGGCA<br>CAGTAGACCTCTAATTGCTGCTTCTGCCTGGCAACGCTGTTAATCAT<br>CTATCTCACACCATCAAGAAGGTGATAGGTGGATCAAATACCCAGCA<br>ATTATTATTGCAGCAGCATCATCGTTTCAGGGAACCCACAACAGCCC<br>AATTCAATTCCGGATCAGGTCAGCTAAAGCAAAATTAACGAGTCCGT<br>AGATTACCTACCAGCGCCGAGAATCTATTCATGTGTATCATACTGAA<br>GTTCTTGAGTTATTATAAGCAAAATTAGATTACACTTATTATTAGCT<br>CGACTCAGTGCCCTGTACGACTTCATAAATCACTGAGCGATATAATT<br>TGTAATCTCTCAAACACTTTGAACTTCAAATGTCAGAAGCATTGAAT<br>CTCACACGGCCTATATCATAAGTAAGTTATTATTGCTCACAGAGATC<br>TCTGCCAATGTTGCATCGTCCTGATGTAATCAAGAGAATTGAATGCC<br>AAGCAACTTCCCATCATCAATTCTTTTAATTCTCAGTGATTCAGTGC |

TABLE 2-continued

Cell Signaling Gene Sequences

| SEQ ID NO | Sequence |
|---|---|
|  | ATGATATTAGATTTTTCATTTACTTCTCTTGAATATGAAATTCCTAATTAATGTGGGAATTACCTTCACCGATTTTGCTGAAAAAAAAAAAAAA |
| 117 | CCCACCTCGTACACACATAAAAATAAAGGGCAGTGAGTTGAACCTGCCACAGCGTATAAGCAATAGCACTGAAAATGAATAAAAATTAAGGCACAGCCTTCTGTTAGCGCCCTACCCAAGTGACCATCCTTGCCCGAGTCTAGCCGCGTGGAATTTTTTGAAGCCTCTATCCACCAATTTGTGCACCCTGTTACAACTCGCCAGTATAGGTCTAAATCTGCATTTACACAACCCACTGGGCTTCTTGCATCAATTCAGACAGGTTTTTGGGTGGCAAAATATTGGGAAATGGCTTATTCAGGCAGGGCTCGGCGTCCCATCTCCTTCCTTCTGAAGCAGTTGAAGACATCCCACTCATATTCTTCGTGGACTCGCTGTAATGGATTTAATGGGCAGTCCATGTTTCAGTCAAATGCCATCAGCAGGTGCAAGGCACCATCATTCAGGCCTACTGCTGAGTTGGGATGGGTTTTGGGTTTTAGCCATTCGTGCAGAGGGTACAGCGCTGAAGTGGGTTCCACAGAGCAAGTGGGTCTAATTAAACAACTGAGAGAAAGGACAAGTGCACCTATGAAGGATGTCAAAGCTGCTCTTGTCGATTGCAACTGGGATCTCGAGGCTGCATATACAGAATTGAGGAAGAAGGGTATTGCAGGTGCATCAAAAAAAGGGGCCCGTATTGCTGCTGAAGGGATACTGGCATTGGCTCAAGATGAGAAAGTGGCTGCTGTTATTGAACTAAACTGCGAGACAGATTTTGTCGCCAGGAATGAAATATTCCAATATCTGGCACATTCTGTGGCAAAGTCAGCATTGACCATGGAGGCCTTACCTGAACTTCTATCAGAATCTGCGACATTAGATCTAAAGCTCCTAGGGGAAATGAACATTATCTTAGATCATCCTAAACTAACTAGGGAGATAACTGTTCAAGATGCAATTATGGAAGTGGCTGCTATCATGGGAGAGAATGTGAAGCTTCGAAGAGGTTTTGCTTTGTCCTCTGCAAATGGCGTTGTTTCCTCGTATCTTCATACTTCTCCGCAACCAGGGCTTGGTCGCATAGCTGGCCTGTTGACATTAGAATCTGAAAATGGGGGTGCACCAACAGAAGTGCTTCAAAGGGTGGGCTCAAATCTTGCAATGCATGTTGTTGCAGCTAGGCCTTTGTTTCTCTCAAAGGATCATGTTGCAACTAAAACATTAGAGGCTGAGCGTGATATCCTCAAAACTCAGGCTGCTGCGTCTGGAAAACCTCAAGCTGCTATAGAGAAAATGGTAGAAGGACAGTTAAGGAAGTTTGTGGAGGAAATTGCACTTTTGGAACAGAAGTTTGTTATGAACGATAAAGTAAATGTCAAGTCTGTACTTGAGGACCTATCAAAGGAGGTTGGACAACAGATCAGGGTGGGAAGTTTCCTTCGAGTGGAGGTTGGTGAAGGCATCCACAGGCAAGAAACTTCCTTTGCTAGTGAGGTAGCAGCTCAAGTCGGATAACTGATTACCTTTCAGATATATAATATAGTCTGACATCAATGGTAAAACTGAAACCTTCAAGAGTTCAGGAATGCCAATTGGCATTTGCTTATTGATGCTCGCCAGTGGCATTTCATAGTCCATTTACAATGAAAATGGCCGATTTTTGGACTTTAGATCTTAGTGGTTGTTCAGTGACTTTGAAAGAGTGATAGCATTTACATTGTTTTGAATGTAGTAGTATATACTATATTCAAATTGTTTCTCATGGAGCACAGAAGAGTAGATTGCCTCAGGTTAAGTTAAGACATGAACCTTTCGAGTAAATAAACCAAGCAGAGAAGCTGGCTGCAGAATGTAAGAATAAAATATATTGCTTTTGTTCAAGTTTTGTTCCGATGCTTTATGCTGATATTGCTCAGATTTGTATGGTGGAAGTGAGCGCTTCATTTTGGGCGGTTTTAGTCAAAACTTTATTCTACATTAAGTAGATTCAAGACTAAGAATAAGAACTAGGCGAGCGCCATACCTTGCTGTGAAGGATAATATGTTATATAAGGGAGAGTCTAA |
| 118 | GGGAAGATCTACCCCACCTGGGATGAAGGCGCCGAACCTTTCAAGGCCACCAAGGACATTCGTCGAAGCCATTCAAATTCCCTTTTGCGATCAGAACTGTGCTGGATTCCTCCCCGTTCCTGCTGGGTGCTGCGAAGTAGCAGAAGAAGAAGCAGCTTCTGGAGGAAAGAGAAGCAGAGGGTTTGCGGTTTGTGGATGCAGAAGAAGAAGGCACCGCCATGGAAGCGAGCGCTGCGGCAGCTGATGGTCACATACAGGGAATTCTGACTCATGGTGGTCGGTATGTACAGTATAATATCTTCGGGAACCTCTTCGAGGTTTCCTCCAAGTACGTTCCTCCGATACGACTTATCGGCCAAGGCGCATATGGCATTGTTTGTGCAGCAGTGAACTCAGAGACAAATGAGCAAGTTGCTATCAAGAAAATTGGCAATTCTTTTGCGAATAGGATTGATGCAAAGAGGACTCTTCGAGAGATTAAGCTTCTATGCCACATGGACCATGAAAATATCATTGCAATTAAAGATGTCATTCGTCCTCCTCAGAGAGAGAATTTTAAAGATGTTTATATTGTATATGAGCTCATGGATACGGATCTCTGCCAGATAATACACTCCAAGCAACCATTATCTGTGGATCATTGTCAGTATTTTATATATCAATTATTGAGAGGGCTCAAGTATATACACTCTGCAAATATTCTGCATAGAGATCTGAAGCCCGGTAATTTGTTTCTAAACGAGGATTGTGACCTAAAAATAGGTGATTTTGGGCTTGCACGGACTACTTCAGACACAGACTCTATGACAGAGTATGTTGTCACTCGCTGGTATCGAGCACCAGAACTACTATTGAATTGTTCAGAGTACACAGCAGCCATTGATATCTGGTCGGTGGGTTGCATTTTCATGGAGATACTAAAGCGGGAGCCCTTGTTTCCTGGTAGTAATTATGTCGAGCAATTAAAGCTCATCACTGAGTTTATTGGTTCACCAGATGATTCTGATCTTGGCTTTTTGCGGAGTGATAATACTAGAAGATACATCAGGCAACTCCCACAGGTCCCTAAGCAACCTTTTGCTCAGAAATTTCCTAACATGGACGAAGATGCCCTAGATTTACTTGAAA |

TABLE 2-continued

Cell Signaling Gene Sequences

SEQ
ID
NO Sequence

AAATGCTTGTATTTGATCCAAGCAAGCGTATCACAGTTGAAGAGGCT
TTGAGTCACCGTTACTTAGCAAGTCTGCATGGCATCAATGAAGAACC
CAGATGCCCTGCCCCATTCAATTTTGATTTTGAACAGGGCACGTTCA
CCGAGGAACACATAAAAGAGCTGATTTGGAGGGAATCTCTTAACTTC
AACCCAGACATGATGGAATAGCTGGAGTAGATGGGCTTGGTATTTAT
CTATTTGTAATCCTTCTTTGGTGGTTATGTTACTATGCTTATACTGT
GCAATCCATCTGTTGGTTTATTATCGGCCTTATGAAAGTTCGCAGAT
CATAGTGCAGACATGGGTGGGCTTGTTTTATTCTTATTCTTGTTTTG
CTCTTATTCTCTGAAGGTTTGGTAAAGGTAAATAATCGGATGGATAT
GTGTACTTTGCATATCCAGACAGAGATTGGAGTTGTGTATTCTAAAT
CGAGGCCAGCTATTGGGCCTTATGCGATTATTATTATTAAACATTAA
AATGTAATAAGTAAATTTAATAATCTAAAGTACATGTCGAGGGAATT
TGTAAAAAAAAAA

119 CTACAACGAAAACTCCTATATATATAGGGTGCCTCGGTCTTCGACTC
CTCATCGAGTCCGCTGTCTGTTGGAAGTATACACAGCTTGCCAGTAC
GCTGTTTTTCTGCTTTTCTGTTTGTGATTTATCAAAGATGGCAGTCC
CCGTGATTGACATGAAGAAGATGTTGAATGGAGAAGAGAGGGAAGTG
ACGATGGCCAAGATACAAAATGCCTGCCAAGAATGGGGCTTCTTTCA
GCTTCTGAACCACGGAATACCTCACGCTCTTCTCGACCGAGTGAAGG
AGCTGTTCAAGGAACATTACAAAAATTCCATGGACGCAGAATTTCAG
AAGTCTGAGATTGTAGGGATGCTTGAAAGTGCTGTCTCCCAAGGCAA
GAATTTCGGTACTACGAAGATAGATGACGACTGGGAAACGGGCTTCT
TCCTCCAGGATGAAACTTATGACACAGTGTCACCTCCTTTGCCTACC
AATCTCAAAGAGACGATGAAAGAATTTAGTGAGGAAGTAAAGATACT
CGCGGAAAGGATATTAGATATAATCTGCGAAAATCTGGGACTGGAGA
AAGGGTATCTGAAAGAAGCCATAGCAGGGGGCAATGGCGACGGCAAA
GCCCCTTTCTTTGGCATAAAAATGGCTCACTACCCGCCATGCCCAAG
GCCAGAACTCGTCGATGGCCTGCGCCCCCACTTGGACGCTGGCGGAG
TCATTCTGCTACTGCAAGATGATGAAGTGGGTGGCCTTCAAGTTCTG
AAGGACGGCACTTGGTTCGACGTCGAACCCATTCGACACGCAATCGT
TATCGACATTGGCGATCAGCTGGAGGTGATGACCAATGGGAAATGCA
AGAGCATGTGGCATCGCGTGCTTTCTAAAAAGGACGCGAATCGAATG
TCGGTCGCAGCGTTTTATAACCCATCGACCAATGCGGAGGTGTTTCC
AGCTCCACAGCTGATCATGAAGGCGACAGAGCAGAATGGCAATGAAA
ATGACAATAATAATATGAATGCCCAAAGTGGCTATAGTTATCCGAAG
TTCGTCTCAAAAGATTATATGAAAGTCTATGGTGAGCAGAAGTTTCT
CGAGAGAGAGCCGCGATTCGAGGCTATGAGAGCACTCTGTTCCCTGA
AGTAATCTTCTTGAGGAGATACTAGCTCCCAGCAATGCTTCACTTTC
AACTGGTTCTGGTTATAAACTTAAAGAATTAGAATTAGATTAATCTA
TATAGGAAATAGAGCTCTTCCCTGTGTATTTTCTTATCGAGTTCCAT
CGCAATATTTAGGATCTTTGTATGGAATAGAATTAGAATAGGATACA
GCAGGTTGGATATTATCCAAGTGGTTATTACTCTTTTGTAATCTCCA
CTCCCAGTAAGCGCGTTAAACTTTATTCGTACAGACTATATTCATAT
CGGAGGACTTTGATGACATATCCTCTTTTAAATTGTGTAAACAGTTA
TGCAGACTTAATTTGAATACTTTATTGAGATGCAACTGTGCATCCAT
TTCTAAGCATTAAAAAAAAAAAAAAAAAA

120 CTCGTGCCGTGACGATGGCCAAGATACAAAATGCCTGCCAAGAATGG
GGCTTCCCTCTCTTCTCCATTCAACATCTTCTTCATGTCAATCACGG
GGACTGCCATGAAGAAGATGTTGAATGGAGAAGAGAGGGAAGTGACG
ATGGCCAAGATACAAAATGCCTGCCAAGAATGGGGCTTCTTTCAGCT
TCTGAACCACGGCATACCTCACGCTCTTCTCGACCGAGTGAAGGAGC
TGTTCAAGGAACATTACAAAAATTCCATGGACGCAGAATTTCAGAAG
TCTGAGATTGTAGGGATGCTTGAAAGTGCTACGAAAATAGATGACGA
CTGGGAAACGGGCTTCTTCCTCCAGGATGAAACTTATGACACAGTGT
CACCTCCTTTGCCTACCAATCTCAAAGAGACGATGAAAGAATTTAGT
GAGGAAGTAAAGATACTCGCGGAAAGAATATTAGATATAATCTGCGA
AAATCTGGGACTGGAGAAAGGGTATCTGAAAGAAGCCATAGCAGGGG
GCAATGGCGACGGCAAAGCCCCTTTCTTTGGCATAAAAATGGCTCAC
TACCCGCCATGCCCAAGGCCAGAACTCGTCGATGGGCTGCGCCCCCA
CTTGGACGCTGGCGGAGTCATTCTGCTACTGCAAGATGATGAAGTGG
GTGGCCTTCAAGTTCTCAAGGACGGCACTTGGTTCGACGTCGAACCC
ATTCGACACGCAATCGTTATCGACATTGGCGATCAGCTGGAGGTGAT
GACCAATGGGAAATGCAAGAGCATGTGGCATCGCGTGCTTTCTAAAA
CGGACGCGAATCGAATGTCGGTCGCAGCGTTTTATAACCCGTCGACC
AATGCGGAGGTGTTTCCAGCTCCACAGCTGATCCTGAAGGCGACAGA
GCAGAATGGCAATGAAAATGACAATAATAACATGAATGCTCAAAGTG
GCTATAGTTATCCGAAGTTCGTCTCAAAAGATTATATGAAAGTCTAT
GGTGAGCAGAAGTTTCTCGAGAGAGAGCCGCGATTCGAGGCTATGAG
AGCACTCTGTTCCCTGAAGTAATCTTCTCGAGGCATACTAGCTCCCC
AGCAATGCTTCACTTTCAACTGGTTCTGGTTATAAACTTATGTTCAA
TAAAGAATTAGAATTAGATTAATCTATATAGGAAATAGAGCTCTTCC

TABLE 2-continued

Cell Signaling Gene Sequences

| SEQ ID NO | Sequence |
|---|---|
| | CTGTGTATTTTCTTACCGAGTTCCATCGCAATATTTAGGATCTTTGT<br>ATGGAATAGAATTAGAATAGGATACAGCCCGTTGGATATTATCCAAG<br>TGGTTATTACTCTTTTGTAATCTCCACTTCCCAGTAAGCGCGTTAAA<br>CTTTATTCGTACAGACTATATTCATATCGGAGGACTTTGATGACATA<br>TCCTCTTTTAAATTGTGTAAACAGTTATGCAGACTTAATTTGAATAC<br>TTTATTGAGATGCAACTGTGCATCCATTTTTAAGCATTAAAAAAAAA<br>A |
| 121 | GTAATTCTCTTTCGTTTTTCCCGTGACATACGGCAGGATTTACTCTG<br>ATTTTTCACAGGAATTCCCAATCTCGCGGAATTTTATTAAGCAGCCG<br>CAGATGGTTTCTGTCGCTGTACCGTCATGGCCATTTCAGAGTAGCAC<br>CGACTGTTCAGCTATCGACAAGTACACGCTAAGCTCCCCAGCATAAT<br>TTGGAGGATTTTGTGAAGAAAAGGCGAAGATTTGGCGGAAATCACTC<br>CAAATCTGGCCGGACTGAGTTCACAACGTGGAGTTGCGGGCCATTGT<br>CAGAATGATCGGGTTTATATTTGCAGAACTGTTCTTACTTGGCAATT<br>TCGGAGGTCGTCTGCTTATTTCCGTCAGAGATATAGAGAGTTTTGAC<br>GAGACTTGGCATTCGGTTGTCGATTTCAGAGGTTTTGATTTGCTTCT<br>TGGTTAGAGGTTTTGATATTTGAGCTGAGTTGGGTTTTTGAGAGTAG<br>GATGGCGAGTCCGTACGGAGATTACGATCAGAGAATTGATTACATGT<br>TTAAGGTGGTAGTGATAGGAGACTCCGCGGTTGGAAAATCACAAATA<br>CTGTCTCGGTTTGCAAAGAATGAGTTCAGCTTGGACTCGAAATCAAC<br>CATTGGAGTCGAATTCCAGACGAGGACAGTCGCTATTGATAACAAGA<br>CTATCAAGACACAAATATGGGACACGGCTGGTCAAGAGAGATACAGG<br>GCAGTTACAAGTGCTTACTACAGGGGTGCTCTTGGGCAATGTTGGT<br>GTACGACATAACCAAGCGCCAAAGCTTCGACCATGTGGCCAGGTGGC<br>TTGAGGAGTTGAGAGGCCATGCCGACAACAATATTGTTATCATGCTG<br>ATTGGCAACAAATGTGACCTTCGTGATATGCGTGCTGTGCCTGAAGA<br>AGATGCAAAAGAATTTGCACAGAGGGAAGGTCTTTACTTCTTTGAAA<br>CATCGGCGCTGGAGGCAATTAATGTGGAGATGGCCTTCATAACAGCT<br>CTGACTGAAATTTACCGGATAGTAAGCAGAAAGGCCCTCACAGCAAA<br>TGAGGATGAAAGGAATGGGAATGCGGCTGCATTAACTGGCACTAAAA<br>TCTCTCTATCAAGCCCAGAGCAGTCTGTGATGGCTGTGAAGAAAAAG<br>AGCTGTTGTTGATCATCTTTATTGTTTATCGTTTCACTCTGTTTGGC<br>AATGACATGATCCCTTTTGTAAAATCGATTTGCATTTTTCAGTCATC<br>CTAAACTGCAGGTCTACTTCCGAGAGTTGTTGAAACCCGTTTAGATT<br>CTAAAATTTCGTTGCCGAAGCACATCTTTGCATCCATGTATTTACAG<br>TATAAGAGATTTTCTCTGCATTCTGATTTGATATCTTGAATATTTTA<br>CAGCGTTTCACTGGTATCAAAATGGAAGCCCATATCTGTAATTAGTT<br>TAGCATTTTCTCAGTCGCTGGCTGAAGGGGTCACATACATTGCTCAT<br>TTCCACTGGCTACCAATGGAATTGCAAGATTTCCCCTTGAACAAAAT<br>GTCACACGTTCTCCGTTGTGAGATCCATGTGAGGAAGTTTTGCCATC<br>ACAAATATTTTTATATGTATTTCATTATTTTGTTATTAAAAAAAAAA<br>AAAA |
| 122 | TCCAGCTTCAGTTTGGGAGTACTACCAGGGATTCACAGGCGAGCAAA<br>ATGGATCGACTGATCAGCGGCCAAACCACGTGCAATTCAGTCGAGAA<br>GCAGAGCAATGGAGATTCGAACCTCGACTATTCAGTTTCCGATGCGG<br>TCAGAGACAAGCTGCGGCTTATGAGAGACAGAATTGAGAAGGAAGAT<br>CCCGCCTCCAAGGTTACAGATGATGGTACTCTTCTACGTTTCTTGTA<br>TGCTCGGGAATCAAATGTGGAAAAGGCTTGTGAGATGTTTGCAAAGT<br>ATAGAAAATGGAGACAGACTTATGTACCCCTTGGATACATCCCAGAA<br>ACAATGGTCGGCAATGAGCTCAAGCACAAATTTGTCTACATGCAAGG<br>ATATGACAAAGTGGGAAGGCCGATAATGGTTCTTCGTCTGGCAAGGC<br>ACATTGCTTCCCAGTCGAATATGGAGGATTTTAAACGTTTTGTTGTC<br>TATGCCTTTGATAAAATGTCTGCTAGTGCTACAAAAGGACAGACAAA<br>GTTTTCCATTATAGCAGATTTTGCTGATTGGGCATACAAGAAGTGA<br>ACCTTCGTGGCACTATTGCAGCTGTTCAAACCTTGCAGGACTTCTAT<br>CCAGAGCGCTTAGGGAAGGTGTACCTTATTAATCGACCATACATATT<br>TTGGGCAGCATGGAAGATAGTTTCTCCTTTTATTGACAAAGTAACAA<br>GGCAAAAGATTGTTTTCACCGACGATAAATATGTCAAAGAAACATTA<br>CTGAAGGATATTGATGAAAATCAACTACCTGAAATCTATGGAGGGAA<br>ATTACCTTTAGTTGCAATTGATGATTGTGTTGTACCAAATTGGCCCC<br>CAATAACCTCATTTTAGGAATCTAGAAGAACTTTAATAGCGATGATC<br>ATATTGAAGTATATTAGTTGTTCTTTAATAGCGATGAGCATATTGAG<br>GTATATTGGTTGTTCTTTAGTGTTTATACCGAAATCATAAATTGTTC<br>CTCAAATTTATTTCAACTTCTTACAAGAACAAAATTTTTAAAACAAT<br>TAAATTGTTCAATGTTAACTATTTAGAATAACTTTTTAAAAAATGTT<br>CAATGTTAACATTTTAGAATAAAAAAAAAA |
| 123 | CGCCTCGGAGGGTTTCTTTGCGCGAAGATCACAGGTCAGAATAGCCA<br>TTTGGTGAAGGGAATCTGTGGTTTCTTATTTCAGAGCACTGGTATCA<br>GTGTTAGTCGTTCGGTTCACGTCATTTTGAGCCCAAATTTGAGGTCT<br>TTCTGTGCGGATTCGGTAAAAAATGACGGAGAAGGAGAGAGAAATC |

TABLE 2-continued

Cell Signaling Gene Sequences

| SEQ ID NO | Sequence |
|---|---|
|  | ATGTTTACATGGCCAAGCTTGCCGAGCAAGCCGAGCGATACGATGAG<br>ATGGTGGATTCAATGAAGAAAGTTGCTAAGTTGGATGTGGAGCTTAC<br>TGTGGAAGAGAGAAACTTGCTCTCAGTTGGCTACAAGAATGTCATTG<br>GTGCAAGAAGAGCTTCATGGCGGATAATGTCTTCCATTGAGCAGAAA<br>GAAGAGGCAAAGGGTAACGAGCTCAATGTCAAACGGATCAAGGAGTA<br>CCGTCACAAAGTTGAAGATGAACTCAGTAGGATTTGCAACGACATTC<br>TTACAATAATTGATGAACATCTCATTCCCTCTTCTAGCACTGGCGAG<br>TCTACAGTTTTCTACTACAAGATGAAGGGGGATTATTATCGGTATCT<br>TGCAGAATTTAAGACAGGAAATGAAAGGAAAGAAGCTGCAGACCAAT<br>CTCTCAAAGCTTATCAGGCTGCTTCAAACACAGCGACTACAGATTTG<br>GCACCTACCCACCCAATCAGGCTTGGGCTGGCATTGAACTTCTCAGT<br>TTTCTACTATGAAATTTTGAACTCGCCTGAGAGGGCCTGCCACTTGG<br>CCAAACAAGCTTTTGATGAAGCAATTGCGGAGCTTGACACTCTCAGT<br>GAAGAGTCATACAAGGACAGCACATTAATCATGCAACTACTGAGAGA<br>CAATCTTACTCTCTGGACTTCAGATTTACAAGAAGAAGGAGGGGAAG<br>ATCAACCCAAAGGTGAAGAGGATAAGATAGAAGAAATTGAGCACTAG<br>TTTCAGAAGGGCAGTGTAATGACTACTTTCAGCATAACAACTGCCAT<br>GGCAGTTGTATGCTGGAAGGTAGTTTATATTTGCTATGTTTCTTCAT<br>TCCTCCGTGCTGGTCGAGGCGCTCTGCATAGACTAAATTGTATTCAT<br>GATTCCTGTTGCCAGTTTTTATTTTTTATTTTGGTGAAGTGGGTTTA<br>AGTTAGGTTGGAACTTTGAAGTACATTAGTGTTCTGCACTTTATATC<br>CTAAGTTGGAGGTCTTTTGAATTTTTAGTTCCACATGCATGGAATGT<br>TGATGCACGATTTTCTGTTTCGTCACTATTAAGTTGATAGGAAGTTT<br>TAATTTGTAAGCCATGAGTTGGCTGATTGGGCTCAAATTTTGGACTT<br>GCCTGCTTTATTTGAGCAGAAGTTGTGGACGTGTCTCTAAATGTAAG<br>AGGTGAATGTATTTGACACTGGACCGTGTGGATGATGCAGATTACTA<br>AAAACCTTGCGTTATGAAAGATGCTACCTATAAAATGTGGTTTGGCT<br>GTTGGTTTTAAAAAAAAAA |
| 124 | CAAGCGAATTTTTTGTTTATTTTAAGTGAAGTCAGATAGTGGTTTGA<br>GCTTCGGTGCGGGATACACAGATCCACGTCTGCATTGAATGCAAACA<br>AAAATCAAGGGTGGTAACCTCGTGTGATCCGCGGGGAGAACCGTCAA<br>ACCACCCTCCCAAATTTTGGTCCCAGTTGTCGCTTTGATTTGATTCG<br>ATCCAGCCGTTTTCGCTCTTCAATTCAACCTTCTTCGCGGTCGGAAA<br>GGTTCAATTTGGAGCAACATCGGACCAAATTGAGAAGCGTTCCAAGT<br>TCCAGTATAAATGCGCAAGGGGACAGCCAACTGAATTCAAGCTCACG<br>AGACCGTGTAGATTTGCCCTGTTGAAGTCTTGGGGGTTCTTTTACAA<br>GCTTCTTCAGCAAAAATTATAATTGACTGCAGAGATGGTCAAACTGA<br>CGATGATTGCTCGTGTTACTGATGGTCTTCCTTTAGCGGAAGGCTTG<br>GATGATGGGCGGGAACAAAGAGACCTGGAATTTTATAAACAGCAGGC<br>CAAGGCATTGTTCAAAAAATTGTCACACGGTCAACATGAACCTTCAA<br>GGATGTCCATTGAAACTGGCCCATTTATATTTCACTATATCATTGAA<br>GCTCGTGTTTGTTACTTAACTATGTGTGATCGCTCTTATCCAAAGAA<br>GCTTGCATTTCAGTACCTTGAGGAGCTAAAAAATGAGTTTGAAAAGT<br>TGTATCAGTCTCAAGTAGAAACTGTTGCAAGACCATATGCTTTTATT<br>AAATTTGATACATTTATTCAGAAGACAAGGAAACTGTACTTGGACAC<br>ACGAACACAGCGGAACCTTGCTAACTAAATGATGATCTATATGAAGT<br>TCAGCAGATAATGACACGCAATGTTCAAGAAGTGTTGGGAGTTGGGG<br>AGAAGCTTGATCAAGTCAGTCAGATGTCTAGTCGTCTGTCATCAGAA<br>TCTCGGAAATATGCTGATAAAGCAAAAGATTTAAGCAGACAGGCATT<br>TATCAAGAAGTGGGCACCTGTGGCCATTGTTCTGGGAGTTGTTTTTG<br>TGCTCCTGTGGATGCGATGGTATATTTGGCAGTGATTTTCTTTCAGT<br>CATTATTACATTACCTGGGTAAGAGTGGAGTTAGCTGCTCAGAGGCA<br>GATAGTAACAAGCAGGTAATATTTTTGAGGGAGGGCATTTGGGGTAG<br>CATTTTGTTTTGGCTTGGTTGCTTTTATTGAATGCAAATTCGAAAT<br>GAGGAAAGAGAGATCTTACTGAGGGCAGTGACCAGTTGTATGCCGAG<br>CTTGATTGGTACAGGTGAACGTGAAACAAGTTTCACTATTTGATGGA<br>TGAGATGAGTAAGATTTTATTTTAGTTGTTAGAATTACAATCTTAGA<br>GGAAGATAATAATATTGTTCTGGTCAGATAGCTTATTCATCAGGGAG<br>ATGAAATTTTAAATATTTACCTTAGGGTTTCTCTGTGATCAGTTGTC<br>ATTGGGGCCATTTTTTCTTTTTACAGTTATTGTAATTATTTGTTGGT<br>ACTTGTCTAGTTATAAAACCAGTATTTGAATATTTCA |
| 125 | AAGAATTCGGCACGGCTTTTTCAAAGGGTACTACTCATTTACCCCTT<br>CAAAATTGGCAGTTGCAATGAACGGAGGAGTTCAGATCTCTTCATAG<br>AAGACGCCGCAGCAGCAACCAGCACGCAAACACTCCATTTAGACACC<br>AACACTCCTTTCATTTGCCCCACGAACGAGAGTCTGTGTGCTCTGTG<br>GTCGAGAGAAGTTTTATTATTAAATGGCGAGGAGAACGGACGATG<br>AGTATGATTATCTATTCAAGGTGGTCCTGATTGGAGATTCAGGAGTA<br>GGGAAGTCCAATCTGCTCTCCAGATTCACGCGCAATGAATTCTGCCT<br>CGAGTCCAAATCTACAATAGGCGTGGAGTTCGCAACTCGCACAGTGC<br>AGGTTGAAGGGAAGACAATAAAAGCACAAATCTGGGATACTGCTGGC<br>CAGGAGCGATACAGAGCAATTACAAGTGCCTATTACCGTGGTGCTGT |

TABLE 2-continued

Cell Signaling Gene Sequences

| SEQ ID NO | Sequence |
|---|---|
| | TGGGGCTTTGCTCGTTTATGATATTACTAAGCCTACAACTTTTGAGA |
| | ATGTTGGAAGATGGTTGAAGGAGCTTAGAGACCATGCAGACTCCAAC |
| | ATAGTGATTATGCTAGTAGGTAACAAATCTGATCTAAAGCATCTACG |
| | AGGCGTATCAACAGAAGACGCTCAGAGTTTTGCTGAGAAAGAGGGTC |
| | TGTCATTTTTAGAGACATCAGCGCTTGAAGCTACTAATGTTGAGAGG |
| | GCTTTTCAAACAATTCTGGCAGAGATACACAGGATAATCAGCAAGAA |
| | GGCCCTTGCCTCAGAGGAGGCTGCAGGAGCTGGCATCAGAGAAGGGA |
| | AAACTATTCTTGTCTCAGAGCCTGATTCTAATACAAAGAAGGCTTGT |
| | TGCTCATAGCAAGATTATATAATGCCTGAAAATATGATATTAGAGCC |
| | CAATCTCATTTTTGGTGAGTTTTGGTTAGGTTTTGTCGAATGATTAC |
| | TTATAACGATATTTTGCTCATTCTTGATGGTAACTTACAGTTGCCTC |
| | TTTTGTTTAGTATTTTGTTGCTGCAAGCTATTATTTGTTTGAGGAGC |
| | AATGGACATGACACCTACATATTTATTTAAGGTAGGGAATATTTTCA |
| | GAAGAAAAAAAAAAAAAAAAAAAAAAAA |
| 126 | GTTGTTTGTTGTTTGATTCTTCTGAGAGTAGGCCCTGCGTGTTCTGA |
| | GACTTTTTTGTCGTTTTAATTTCTATTGAACTTGGCTCGTCATTTGT |
| | TCATTTTCAAGTATTGATTTGATGTATAGGAGGTGACAACTTCTGTA |
| | AGTTTTTAGATGGATCAGGACCAATCCATCTGCAGATTTGCAGCTCA |
| | GAAGGGAAAAGGAGAGATTCAGTCTTCTTCATTCCCAGACGAAGTTT |
| | TGGAACATGTTTTGGTTTTCCTGTCCTCCCAGAAGGACAGAAATTCT |
| | GTTTCCTTGGTATGCAAGGCCTGGCACAGGGTTGAGGCGTGGACGCG |
| | CCAGCAGGTGTTCATTGGCAACTGTTATGCTGTCTCCCCACAGATTA |
| | TGATAAAAGGTTTCCCAAGATCAAGTCTGTCTCACTCAAGGGGAAG |
| | CCCAGATTTGCAGATTTTAATTTGGTGCCACCAAATTGGGGGCCCA |
| | TCTCACTCCATGGGTGTCGGCCATGGCAACTGCTTATCCATTACTTG |
| | AGAGGCTGTACTTGAAGAGGATGACTATCACAGATTATGATCTCACA |
| | TTGCTTGCAAATTCCTTCCTATATTTCAAGGAGCTTGTTATGGTTTG |
| | TTGTGATGGATTCAGCACAGGTGGCCTCGCTTCGATCGCAAGCAAAT |
| | GCAGGCAATTGACCACACTTGATTTGAATGAGGACGAGATACATGAT |
| | AATGGAGAAGATTGGCTGGCTTGCTTTCCTGAGACTTTTGACGTCTCT |
| | AAGATCTCTTTGTTTTGATTGTTTGGAGGGCCCAGTAAATTTTGATG |
| | CACTAGAAAGATTAGTTGCAAGATGCCCCTCTCTGAAGAAGCTCAGG |
| | CTAAATAGAAATGTTTCTATAGTGCAATTACAAAGGTTGATAATAAA |
| | AGCACCACAGCTTACTCATCTAGGAACAGGCTCATTTTTCTATGAGT |
| | TCCAACTGGAGCAAGTAGCAGATCTTCTCGCAGCCTTCAGCAATTGT |
| | AAACAACTTCAATGTTTGTCAGGATTTCGTGAAGTTGTGCCAGAGTA |
| | TCTACCTGCGGTATATCCAGTTTGCTCTAATTTAACATCTCTAAACT |
| | TCAGCTATGCTGTTATTGGCAGCAGAGAGTTGGAAGGAATAGTCTGT |
| | CACTGTCGTAAATTGCAGCTACTCTGGGTTTTGGATTCGGTAGGAGA |
| | CAAAGGTTTGGAGGCAGCAGCTACAACGTGCAAGGATCTGAGGGATC |
| | TCCGTGTATTTCCTGTGGATGCACGTGAAGACGGTGAAGGTTGTGTA |
| | TCTGAACGGGGCCTTGTTGCAATCTCCGAGGGGTGTCCAAATCTTGA |
| | GTCCATTCTATACTTTTGTCAGCGTATGACCAATAAAGCAGTTGTGA |
| | CCATGTCGCATAACTGTTCCAAACTTGCCAGCTTTCGTCTCTGTATC |
| | ATGGGTCGACACCAACCTGATCATTTAACTGGTGAACCTATGGATGA |
| | GGGATTTGGGGCAATCGTAAGAAACTGCAAAAGCCTAACAAGGTTGG |
| | CAGTATCCGGTCTACTCACTGACAAAGCATTTCAGTATTTTGGAGCC |
| | TATGGTGAAAGATTAGAGACCTTATCAGTAGCATTTGCCGGGGAAAG |
| | TGACCTCAGCATGAAGTATGTGCTCGATGGATGCAAGAACCTTCGGA |
| | AGCTGGAGATTAGAGACAGTCCATTTGGAGATGTTGCCCTCTTGTCT |
| | GGTTTACATCACTATGAAAATATGCGGTTTTTGTGGATGTCTGATTG |
| | CAGACTCACTCTACAGGGATGCACAGAGCTGGCCAAGAAGATGCCTG |
| | GACTTAATGTTGAAATAATCAGAGAAAATGAATGCAATGATTCTCTT |
| | GTTGAGAAACTTTATGCTTATCGCACTGTAGCAGGTCCACGGAAAGA |
| | CATGCCGTCATTTGTAACCATCTTATAGCCACTTCACATGAATTTCG |
| | TGGTTATGGCTCTGCTACATATGGGCAACCTGTTAGGGCTATCCTAC |
| | TAAATTAATCATGCATCAATGTTACTGATGAAAAAGCCCATGTCCAT |
| | AATGCCTTTACTTCACCAAAGGAGGAGCAATAGAGCAGGCCAGGTTA |
| | TTGCCATTTTACTTTGGAAACTTTCTTCAGGTTGTAGCTGCCACCTG |
| | AAGGGTTGGAAGAATGTACGATTCACTGATGCAGACTGCTAATTCTT |
| | GTTGCTCCCTAAAGTTGAATCTAGTTAAATGCCAAACAATAAACTGG |
| | TGATAGAAATGCTGAAGGTGATGAAAGGTGGAGAATTACAGATGAAT |
| | CCCTTCTGCGTGCATTGGATAGTGTTTTAAGGGACTGAATGCCTCAA |
| | TTGGTCTGTTTGTTTTAATTTCAAACAATTGACCTGTCTTTGATGCA |
| | ATCTGTGCTTTGACTTGAATTCAATCTGTGATTTGACTTGAATTTTA |
| | TTTGCTATATGACTGATCCGGAGCTTGTTGAGGAGGTTTGGAATTGT |
| | TCCGAGGGAAAATTTCTGAGTTTATCATGTTATACTGATTAATTGCT |
| | TGAATTATCAAAAAAAAAA |
| 127 | GGAAAGAGCCCACCTGGGGCTGGCTATTTCATTCATTTTGACGTCAA |
| | TTGCCGCATTACAACGGCAGCCGAGCAGAACGGAACGAAATCGGCAA |
| | TGCAGATATCTAGCGAGCGCAGTCGATGGCCTGCTGCTTCCCTCCAT |

TABLE 2-continued

Cell Signaling Gene Sequences

| SEQ ID NO | Sequence |
|---|---|
| | TAGCCGGTAGACGACGACAAACCATTTCCCCTCCAAGGAATTCCCGT<br>CAAGAAGGGCAATATTGCCGTCAAGAAGACGAGCAATTTCCCCT<br>TCAAGGAATTTCCATCAGAATTCAGCCCTGGGGGACAATTGGAGGCT<br>CAGGACGGACAGCGGTTTCGTAATCCGCAGCAGAGGTAGATGGGGTA<br>AATGCGGTTAACCGGATTCCGGTGGCCTCAGCTCAACTCATGAAAAA<br>TTTCAGTCGGATCTGATCTTTCTTTTTTTCTTTTTTCTCCCTAGATT<br>TTTGTCACTCGAGGCCGATTCAAAGGGCGTCGTAGCTTTGGAGATCT<br>CGAGCGTTCGAGATATCGAACCCGAGCGGCAGCGATGCAGCAGGACC<br>AGAGGCGAAAGAACTCTTCTGAGATAGAATTTTTCACAGAGTATGGA<br>GGGGCTAGTCGCTACAAGATTCAGGAGGTGATTGGCAAAGGAAGCTA<br>TGGTGTTGTATGCTCAGCAATTGATACACATACAGGGGAGAAAGTTG<br>CAATTAAGAAGATAACCAATATTTTTGAGCATTTGTCTGATGCAACC<br>CGGATTCTACGGGAAATCAAACTTCTCAGGTTGCTGCGCCATCCTGA<br>CATTGTAGAAATCAAGCATATCATGCTACCTCCCTCACAGAGAGAAT<br>TCAAAGACATTTATGTGGTATTTGAACTTATGGAGTCTGACCTACAC<br>CAGGTTATAAAGGCTAATGATGACTTGACACCAGAACATTATCAGTT<br>CTTCCTGTACCAACTTCTTCGAGCATTAAAATACATACACACAGCAA<br>ATGTGTTTCATCGGGATCTCAAGCCAAAGAATGTCCTTGCCAATGCG<br>GACTGCAAGCTCAAAATTTGTGACTTTGGCTTAGCAAGAGTTGCCTT<br>CAATGACACTCCTACAGCAATCTTCTGGACTGATTATGTTGCTACAC<br>GATGGTATCGGGCTCCTGAGTTATGTGGTTCATTTTTCTCAAAGTAT<br>ACTCCTGCCATTGATATTTGGAGTATTGGTTGCATATTTGCTGAAGT<br>CTTGACTGGAAAGCCGCTTTTCCCAGGCAAAATGTTGTTCATCAGC<br>TAGATTTGATGACGGATCTTCTTGGCACTCCTTCCCCAGAAACAATT<br>GCAAGGGTTCGTAATGAAAAAGCTAGAAGATACTTGAATAGCATGCG<br>CAAGAAACAACCTGTACCTTTTACACAAAAATTTGTGGGTGCAGATC<br>ATTTAGCACTTAAACTTTTGGAAAGATTGCTTGCGTTTGATCCGAAG<br>GATCGTCCTACTGCAGAAGAGGCTTTGGCCGATCCTTATTTTAGGGG<br>GTTAGCAAAAGTAGCCCGAGAGCCTGTAGCTCAGCCAATAACTAAAA<br>TGGAGTTCGAGTTTGAGAGACGGAGGGTTACAAAAGATGATGTGAGA<br>GAACTTATTTATCGTGAAATACTTGAATATCATCCGCAGATAATGAA<br>AGAATACCTGAATGGAACAGATCGCACAAACTTTATGTATCCTAGTG<br>CTGTTGATCAATTTAAGAGACAGTTTGCTCACCTGGAGGAGCACTAT<br>GGGAAAGGTGGATCAGTTCCTCCATTAGAAAGGCAGCATGCATCTTT<br>GCCAAGACCCTGTGTTGTCTATTCAAACTCTGGTGGGCCCTCATCAG<br>AGCAGGCATCTTCAGGTCCTTCCAGGGATCGTGCTTTAGAAGTTCGT<br>GAAGAAGCTCCAAGGTATAGTAGAGAAGGAGAGAAGCAGCACCAAGA<br>CAGGAGCTCCGGAAATGTGAAAGTGCCCTTGCATGCAAGTCATAAAG<br>TTTTGCAAGGAAGTACTGCAAAACCGGGAAAAGTAATTGGTCCTGTA<br>TTACCCTGTGAAAATGGAAGCATTAAAGAAGCATATAATCCAAGAAG<br>GTTGATCAGAAATGCTGGTGTTGCACCATCTCAGTGTCCTGCTCCAA<br>TTTATTCCTATCCAAGACGAAATTCCACAGCGAAAACTGAGGTTGAT<br>GATAAGAGGGAAGATGGAATTAATCAGTTTAATGTATCACAACATAA<br>GACTCAGTATGTTGGAATTGGTGCAGCAAGGAAAGTGGCTGCTCTTG<br>AAAGCAGGTCATCTCATTTGTATTAAATAAGGTGGATTATTAAATCG<br>CGTATTTTTAACTTATCTAATATCTATTTACTGACTCGATTCTTTAA<br>AAAAAAAA |
| 128 | CTTTCTTCGACATCTCCGCTCTTTAGTTAATGGGTCTCTCATTTCCT<br>GAACGTCTAGGCAGGCCTATCCAGAATAAACTAGAGCGGAATATCAT<br>CTTTTGCTTTGCTGGACCGGGATGTAGAACTCCTGAACGGTAGCCCT<br>CGCTGCGAATTTGATGTGCTAGGATTCCTTTATTAGTTGTTGTTACT<br>TAGTGCTTGAAAGTGGCTTTCCTAGGAGTATTTTCTTGTTCCAACAA<br>TCCCAGTTAGAAGGATCATTCTACAATGAAAATTTCATCTCAGCGAT<br>ATGAGAGATTGTGAAGGTATTTAAAAAACCTCGGAGCAGCGAGACCA<br>ATCCCTCGCAAAATCCCGACCAGCAATCGAATTACGGCAATGGCAGA<br>CGATTTGGGAGAGTTTTACGTTAGGTACTACGTGGGTCACAAGGGCA<br>AATTCGGCCACGAGTTTCTCGAGTTCGAATTCCGTCCCGACGGCAAG<br>CTCCGCTATGCAAACAATTCGAACTACAAGAACGACACCATGATTCG<br>CAAAGAGGTGTTCCTTACACAGGCTGTTCTCAGGGAATGCCGACGAA<br>TCATTGCCGAAAGCGAGATAATGAAGGAAGACGATAACAACTGGCCT<br>GAGCCTGATAGGGTTGGACGTCAGGAGCTGGAAATAGTTATGGGGAA<br>CGAGCATATTTCCTTTACTACTTCCAAAATAGGATCTCTTGTTGATG<br>TCCAAAGTAGCAAGGATCCCGAAGGCCTTCGGATTTTCTATTATCTT<br>GTTCAGGACCTCAAGTGCTTTGTGTTCTCTCATTGGTCTTCACTT<br>CAAAATTAAGCCTATCTAGCCATAAATGGTGGTTGCATATACGTGCA<br>AATGCATATTATATGATTGAAGATTTACATTAAAGAGCACAATGGAT<br>CTTTTTGTACGCTAGTAGCTCCGGAAGGATTGATTAACATGGATGCG<br>AAGTTTTTTTTTTTTTTCCAAATATTTATTAATACTAAAGAGCAT<br>AACATACCTTTCTAACCGAGGAGATCCCGATGGACTGATCACGATGT<br>GTATGTGAAGCGTGTTTTAAAACATTAGATTTATCGTAGTCCAGTCA<br>TTTCTATAATTTCGAGTTTTAGCTCGTCGGTTGATTCGTTTGTGTTC<br>ACGTGAATTTTGTGTGGCTTCTTAACTGTTGTAATTATCCGGCATTC |

TABLE 2-continued

Cell Signaling Gene Sequences

| SEQ ID NO | Sequence |
|---|---|
| | CAAGTTGCATTTTTTGGTGGCGCGTTATGCTCTTGGGTCATAACACG<br>TGGGTGA |
| 129 | CCTTGGTGTTGGGAGCACTGTCCACGGTAATCAAAATTTCATCTCAG<br>CGATATGAGATTGTAAAGATATTTCAAAACCCTTGGAGCAGCGATAC<br>CAATCCCTCGCAAAATAGCTGAAATTGGTATTTACAAACCCTTGGAG<br>CAGCGATACCAATCCCTCGCAAAATAGCTGAGATTGGTATTTACAAA<br>CCCTTGGAGCAGCGATACCAATCCCTCGCAAAATGCCCCCGACCAGC<br>GATCGAATTCCGGCAATGGCAGATGATCTGGGAGAGTTTTACGTTAG<br>GTACTACGTGGGTCACAAGGGCAAATTCGGCCACGAGTTTCTCGAGT<br>TTGAATTTCGTCCCGACGGCAAGCTCCGCTATGCAAACAATTCGAAC<br>TACAAGAACGACACCATGATCCGCAAAGAGGTTTTCCTTACTCAGGC<br>TGTTCTCAGGGAATGCCGACGGATAATTGCCGAAAGCGAGATAATGA<br>AGGAGGACGATAACAACTGGCCTGAGCCGGATAGGGTTGGGCGTCAG<br>GAGCTGGAAATAGTTATGGGGAACGAGCATATTTCCTTTACTACTTC<br>CAAAATAGGATCTCTTGTCGATGTGCAAAGTAGCAAGGATCCCGAAG<br>GCCTTCGGATTTTCTATTATCTTGTTCAGGACCTCAAGTGTTTTGTG<br>TTCTCTCTCATTGGTCTGCACTTCAAAATTAAGCCAATCTAGACATA<br>AATGGTTGCATATACGTGCAGATGCATATTATATGATTTGAAGATTT<br>ATATTAAAGAGCACAATGGATCTTTTTGTACGCTAGTATCTCCGGAA<br>GGACTGATTAACATGGATGTGAAGTCTTTTTTCCAAATATCTATTTT<br>GTACTAAAGAGCATAACATGCCTTTCTAATCGAGCAGATATTGATGG<br>ACTGAACACGATGTGTATATGGAGCGTGCTTTAAAACATTAGATTTA<br>TTTTACTCCAGTCATTTCTATATTTTTGAGTTTTAGCTCGTCGGTTG<br>ATTCGTTTGTGTTCACATGATTCTTTTGTCGCTTCTTAACTGTTGTA<br>ATTATCTGGCATTTCAAGTTACATTTTTTGGTGGGCGTTATGCTCG<br>TGGGTGGATGTATACTGGTTTTTAACCTTTCTCTAAAAAAAAAA |
| 130 | 1 gcgccagtcc gggcacgaac gacaagagga ccatcaccgt ttccgttccg gacacggcgg<br>61 gagctccctc tctccttcct ccatttaaag ggctgaagag aagtcgatcg gtgtacgttg<br>121 ttgtcgtcag gttgcaggtt cgaaccccat acccgctagc cattgccaga ttgcacggcc<br>181 cacctgttcg acgtgcgtga cagtcttcaa gtcaggtggc tggtagattc acgattttca<br>241 ttttaagtgc ggtgaacagg taaaaacgca aaaacgcatc gcaatcataa ttccatcgtg<br>301 ttggcaaccc agctctcgcc gaccagtggg aatgaccgaa agactgaagg tctagttttt<br>361 ggggttttgg ataaatttt gcgtttaaca gggcggcatt tgatttttct gctttaaaac<br>421 ggacattata gattggttcg gttcagtttt ctggatctcc gtgcttcggc ccgcagagat<br>481 ccatgattag aaattcgtct cctatatctc ctgcttgacg gaaacactgg aagtgtgaat<br>541 tgacgggaat aaacgagtct ctagagtctg ctggttcatg atggggcaca acacttctga<br>601 agccatcaaa cagatgaccg ctttcatcga tggagtcgac gagccattga agaagtcttt<br>661 ccagactatg catcgaggat atgcacagca aactctagag aggtttctaa aggcacggga<br>721 agggaatgtt cagaaagcaa acaaaatgtt gctagattgc ttaagttgga gagttcaaaa<br>781 tcacattgat aacatcttag cgaaacctat agaaccaaga gaagtttata atgctgttcg<br>841 ggaatcacag ctcatgggga tgacagggta ctgcaaaaag ggacgtcctg tttttgctat<br>901 tggagtgggg cttagtggat atgacaaagc atctgctgac aaatatgtgc agtcacatat<br>961 acagataaat gagtaccgag accaagttct attgccaaat gcatcaaaga aatatgggag<br>1021 ctacattgga ccatgcttga aaatcttgga catgacgggg ctgaaacttt ctgctttaaa<br>1081 ccgcattaag atattgacta cgatagctac agttgatgac cttaattatc cagagaagac<br>1141 ggagacatat tatattgtta atgctccata tgttttttct gcctgttgga aggttgtgaa<br>1201 acccttgttg caagaaagga ctagacgaaa agtacaggtg ttgcaaggtt gtggtaggga<br>1261 agagttactg aaggtaatgg actatgatgt tcttcctcat ttcagcaggc aggagggctc<br>1321 agggtcatcc aaacatcata atggcaagac gatagattgc tttttctccag atcatccatt |

TABLE 2-continued

Cell Signaling Gene Sequences

| SEQ ID NO | Sequence |
|---|---|
| | 1381 tcatgtagaa ctttataatt atattaaaca gcaagcagcg attataaagc ctgttgcccc |
| | 1441 ggaaaaaatg cgatcttttc atgtggatgt tccagagcag gatgatgaag gaaccattat |
| | 1501 tgtacagaca ctagaatctg cattacataa tttaggtgat gaagaggcag ttgagaatgg |
| | 1561 tgttgctaat ttgaatgtca atggggatca atctctgaga caccgaaaag cagctagaaa |
| | 1621 tgaggttcaa ggttgagtat gctgaaagtc gattggatat ttaaataact ggcccacata |
| | 1681 tctggaaatc tgagttgaca atgtgtgaca ttgtgttgtt atccttcagt atcagggtta |
| | 1741 atattgtata caattctcca gtttgacaat ctgatctcaa actggtgttt tgcctcataa |
| | 1801 tgtaattgca ttagattatc ttattttgtg ggagcggttg ccactcccat attctgcaaa |
| | 1861 atgtcaaaaa tgaaatcctt attttaaaaa aaaaa |
| 131 | GGGATAGTTGTGCTCCGAGGAAAGCATTGAATTGGGGATAATGGCGG
AAACTGTCACATATTCATGGCCGGTGGGTTTCGTCTGTTTCGTTCTG
ACGATGTTACTACTTCAACTCTACAGAATAGTGTGGAGGGAGGACAG
TCGAGGCTACAATTTGCCTCCCGGTTCCAGTGGGTGGCCATTGATTG
GAGAGACCTTGAGCTTCATGCGAGGGATTATTCCATTTCTAAACCAC
GCCAATTCATTCAAGATCGAGAGCAAAGGTATGGGAAGATATTCAGA
ACAAATTTGTTTGGAAGATCTCGAATGATTGTGTCTGTGGACCCAGA
ATTCAACAAGTATATTCTGCAACACGAAGGCAGGCTGGTTCAATCCA
GCTATCTGAGACCTTTTCGAAAACTCATCGGCAAATACGGTTTGCTT
TCGGTGTACGGAGATCTCCAGAAGAAGCTCCACGGAACGGCCGTAAA
TTTCCTGAGGTTCGAGAGGCTGAGTGTGCACTTCATGGAGGACATAC
AGAACCTTATGCACACCACCTTCGCCCAGTGGCAAGCCAAGGGGCAT
ATCCATCTTTATCATGAGTGCCATCAGTTTGTTCTGAACTTGATGGC
AAAACAATTGCTGGACTTATCGCCGTCCAAGGAGACGGAAGAGATCG
GTAAAGCATTCGGCGATTTTTCTAAATCTTTCGTTGTCCTTCCCATT
AGAATCCCGGGTACAGCGTACTGGAAAGGATTGAAGGCCAGAGATTT
TCTGATGAAAAAGATTTATGCGAGTATAAAGTACAGAAGGGAGCATC
CAGAAGTTGTCCATAATGATTTCTTAGGAGAACTCTTGAAAGAAGAC
TTGCATTCCGAAGAAATTATAGCAGATTTTGTACTATTCCTGCTCTT
CGCTGGTCACGAGACGTCAGCCTCAACGATGGCATTTGCTATCAAAT
TTCTCACGGACTGTCCCCAGGCACTTCGGGAGCTGAAGGCGGAACAC
AACGCTCTGTTAAAGAGAAAGGGGAGTCCAAGAAACCAAAACCTCAC
TTGGGATGACTACCAGTCACTGAATTCACCCAATGTGTCATAATGAA
ACACATCGTCTCGCCAACGTTGCTCCAGCGGTTTTCAGAGAAGCAAT
AGCAGACATTAAAATTAAAGGCTTTGTCATCCCAAAAGGGTGGTCAG
TCTTGGTGCTTATGAATGGCATCCATTTGGACGACAAGTACCATTCT
TCTCCGCTCAAGTTTGACCCATGGCGTTGGCAACAGATTCTGGAAAA
TAATGAGCTCTACAAGAACCCCTCTTTTATGCCATTTGGAGGGGGGC
TCAGGCTCTGTCCAGGAATGCATCTGGCAAAACTTGAGCTGGGCCTC
TTTCTCCATCACTTCATCACCAAATTCAGATGGGAGCCACTAGATGA
TGATAAGATCTCCTACTTTCCTGTTTCCCACTTGACTAAAGGCTTTC
CGATCCGTCTACATCCTCAAGAACAAATGGATGATTAATCGCAGTAT
AATAGGATTTGATTGATGCAGTATGGAGTATTAGTAACAGTAAATAA
GTTTGAAAAAATGGATAATTAATCGCATTATAATAGGATTTGATTCA
TGCAGTGTGGAGTATTAAAAACAGTAAATAAGTATGAAGCTTAAAAC
AATAATTGCCCCGCTGTGGACATATAAATATCATGTCCGTTGGTGTG
AGTAGATATCATGTCAGTTGGTGTGAGTAGATTTCAAGGATATTTAT
GTATTTCCTGTATTGAAGCGTGAGGATAATGTATTAACCATAAAAAA
AAAA |
| 132 | ACACGGAGAGGGATCATAAGCTCAAATGTCTTCGGCCTGGGAGTGCC
GCCACGAACAAAATGGATCGACTGAGCAACGGCCAAACCACCTGCAA
TTCAGTGGAGAAAGGGAACGATGGAGGTCTGAATTTCGATAATTCAA
TTTCCGACGCGGTCAGAACCAAGCTGAGGCAAATGCGAGATGTCATT
GAGAAGGAAGATCCCAGCTCCAAGGTTACAGATGATGATACTCTTCG
ACGTTTCCTGTATGCTCGGGAATTGAATGTGGAGAAGGCTTCTGTGA
TGTTTTCAAAGTATCGAAATGGAGACAAACTTTTGTACCCCTTGGG
TACATCCCAGAGACAATGATCCGTGATGAGCTCATGAAAAATTCTGT
CCACATGCAAGGATTTGACAAAAGAGGGAGGCCAATTGCAGTCATCT
TTCTAGCAAGGCACATCCCTTGCCGTAAGACAATAGAAAATTTAAAA
TGTCATTTTGTCTACATTTTCGATAAAATGTCTGCTAGTTCAAGAGG
ACAGACAAAGTTTACCATTATAGCAGATTTTGATGGTTGGACGTACA
AGAATGTAGACATTCGTGGTGCTATTGCAGTCCTTGAAATCTTGCAG
GATTACTATCCAGAACGCTTAGGAAAGGTGTACCTTATTCATCGACC |

TABLE 2-continued

Cell Signaling Gene Sequences

| SEQ ID NO | Sequence |
|---|---|
|  | ATATATATTTTGGGCAGCATGGAAGATTGTGTCTCCTTTCATCGATC<br>AAGTAACAAGGGAAAGATTGTTTTTGTTGAAGACAAACATTTGAATG<br>AACACTACTAAATGATATCGATGAAGTCAACTTCCTGAAATCTATGG<br>AGGGAAATTGCCTTTAGTAAAAATTCAAGATTGTGTTGTACCAAATT<br>GGCCCCCAATTACCTCCACATAAGAATATAGAGGAATTTCAATATGA<br>TCTTATTGAAGTATATTAACCCCTATTTGGCTATTATATTGTAATCT<br>TGAATCCTTCCTTAAATTATGTGGTCCTCTTATATGAATTGTAATGT<br>TCTTAAAACATAAAATGAGAAAGGAATGTTAAATGAGGAAACTTTCA<br>TTTATATTTTAATAAAAAAAAAA |
| 133 | CTTTGCTTTGACGGGAAGACAGGTATGTTTTCTGCAAGACCCGATTT<br>GCTTTTATGAGGGCTTTTTTAGGCGTAATCGCTTTGTTTGGATCGCA<br>CTGGACTATAATTGTTCGGTCCTTTTCCATTTTTTGGCTGTTTAAG<br>AACCCTGTTGTTCATAATATTTGTTTTCTCTTTGCCTCAAACCCTTT<br>CAGCGCTTGTTTGTTTATTGGTATCAGACCTTTTTCGTGTTTGGTTT<br>TCTAAATTAACGTATAAATTCATATCGGATTGCCTCTTTTTAAATCT<br>AATTATTGGTTTCCAATTTCTGGATTTATAATCTTGTTTTGGGCTGC<br>TTTTTTATTCTGGTGGCTTGGCCTTTTCAGCATCTCTGGAGAGAAAA<br>TGTTATTGGTATCTTCAGTAACCCCCATGGTAGCAAAGTCTTCCGTC<br>TTTGCTATCTGTTCGTCATCTGAATTCAGGGAACATCTCCTTTCTTC<br>TATCTTCATTTAACCCTACAAGGGTTTCTGTTAATGCAATTCAAACA<br>AACTGTTTGAATTCCGGGGCTGGGGTTTGTTTCTTTTCCCTGTCCTT<br>TATAGGAAGAAAAGGAAAAATGACTGGTGTAGAATATGACGCCAGTG<br>ATAAGGACAGGGAACCCTTTGTGGAAGTGGATCCCACTGGCAGGTAT<br>GGTCGCTATGAAGATGTGTTGGGTCGTGGTGCCATGAAGACGGTATA<br>CAGAGCTTTTGACCAGGAAGATGGTATTGAGGTTGCTTGGAACAAGG<br>TGTCTCTGCAAATCTTGATGATGTTTCCCTTGAGAGGATCTATTCAG<br>AAGTCCGTCTGTTGAAGTCTCTCAGGAATGGAAACATCATTATGTTC<br>TACAATGCCTGGTTGGATAGAAAAACAGGGCATGTGAATTTCATTAC<br>CGAAGTTTGCACCTCGGGTACCCTGAGGCAGTACCGTCAGAAGCACC<br>GCCATGTCTCCATGAAGGCCGTGAAGAACTGGGCACGCCAGATACTG<br>GATGGATTGCATTATCTGCATAGTCATATCCCTTGCATAATTCACAG<br>AGATTTGAATTGCAGCAACATTTTCGTGAATGGAATACTGGCATTCT<br>TAAGATTGGGGATCTGGGTCTTGCTGCTGCCCTGGAAAATGATCATG<br>CTGCACACACTATTATTGGTACACCAGAATTCATGGCCCCGGAATTA<br>TATGAAGAGGATTACAATGAGCTTGTCGATGTTTATTCCTTTGGCAT<br>GTGCTTGCTGGAGATGGTTACTCTGGAGATTCCTTACAGTGAGTGCC<br>GTAGCGTTGCTCAAATTTATAAGAAGGTGAGTTCTGGTATAAGGCCC<br>GCAGCACTGGAAAAAGTTACCAATCAAGAAGTGAGGCAATTTATTGA<br>AAAATGTCTGGCAGTTACATCGGCAAGGCCTTCTGCTGCCGAACTTC<br>TGAAGGACCCATTCCTCAGCGAAGTACAATCGAGTAGCTAGTACATA<br>TGCATGTTTGAGTGCTCAATTATTTTAAGATTGAGTTGGGGGTTTCT<br>GCCAGCGTCTGTAGGAACTGTTGGTGGAAATATGTGATGCCAAATGC<br>TAGGAAAAATTATTTAGATATTATTGCATGTATCTGTGGGATTTTGA<br>TTATTTTTAAGCAATTATCGGGATTAAAAAAAAAA |
| 134 | GACAACTTCTGCAACTCATACATTAGGAATACCGTCTTAGCAACAGC<br>ATCGGCTACCATCATGCCGTATTACGTGCTTCAACGAGAGGTTGAAT<br>CAGAATTTCTGGAGGTTGATCCCACTGGTCGCTATGGCCGGTACAAT<br>GATGTGCTTGGCAAGGGAGCATCGAAGACTGTATACAGAGCCTTTGA<br>TGAAATAGAGGGGATTGAAGTGGCGTGGAACCAAGTGAAAGTGAATG<br>ATATTCTGCAGTCACCTGAGGATCTGGAGAGACTTTATTCAGAGGTC<br>CATCTTCTGAAGACTCTGAAGCACAAGAATATCATCAAATTCTTTTC<br>ATCATGGATCGATACCACGACAAGGAACATCAACTTTATTACAGAGA<br>TGTTCACATCTGGTACTCTTAGGCAATATAGACAAAAACACAAACGT<br>GTAGACTTAAGAGCTGTGAAGAATTGGGCTCGTCAGATCTTGAGAGG<br>GCTTCTATACCTGCACAGCCATGATCCTCCCATAATACACAGAGATT<br>TGAAGTGTGACAACATATTTGTCAATGGGAATCAGGGGAAGTTAAG<br>ATTGGAGACCTTGGGCTTGCTGCAATTCTGCGTAAATCTCATTCAGC<br>TCACACCGTTATCGGAACCCCGGAATTCATGGCCCCTGAGCTGTACG<br>ACGAGGAATATAATGAATTAGTTGACATCTATGCATTTGGGATGTGC<br>CTATTGGAAATGCTCACCTTTGAGTATCCTTACAGCGAATGCTCCAA<br>CCCAGCTCAGATCTACAAGAAAGTAACATCTGGGAAAAAACCAGCAG<br>CTCTGTACAAACTGAAGGATCCTGAAGTGAGACAGTTTGTTGAGAAA<br>TGCTTGGTCACTGTTTCCAGAAGGCTTCCTGCAAGAGAGCTCTTAAT<br>GGACCCATTCTTCAGACTGATGAGCACGGCTTAGAATATTCCTTTT<br>CCAGATTAGATTTCTGCAAAGATGATGTGGGGGAACTTGGCCCGTTA<br>TTAAGAGAACCTAACATTGAAGCTTTTCAAAATGGTGCTCATAAATT<br>ACTCCAAAGCATTCATCTTGTGCATCCTTGTAGCAAGAATGAGATTT<br>CTGTCCACCATGAGAACAAAAACAACAAAAGGTTGTACCTTTGCCC<br>TCATACATTAGAGAGGACAGTATGTCTCACAACATGGATTTCACTGT<br>CAAAGGCAAGAAGAGGGAGGATGACACAATATTTTTAAGACTTCGAA<br>TTGCAGACACTGAAGGGCGCATTCGTAATATCTATTTCCCATTTGAT |

TABLE 2-continued

Cell Signaling Gene Sequences

| SEQ ID NO | Sequence |
|---|---|
| | GTGGAAGAAGATACAGCCATGAGTGTGGCCAGTGAAATGGTTGCGGA |
| | GCTTGACCTTGCTGATCAGGATGTTACAAAGATTGCAGAAATGATTG |
| | ATGAAGAAATAATGGCATTGGTACCTGATTGGAAGGCAGGGGTAGCA |
| | ATAGATGATCACCATTCCTTCTATGACCATTACCATTCCTCCAACAA |
| | AACAAGTGAAACTTGCTGGTGGAATCATAACGATCATGCCTCCAGTA |
| | TCTCTTCTCAGAGTTCCCTGTTGGAATACCTGAGGTCTCATTACCAC |
| | GTTGACAACAAATCAGAAATAGTGCCTTGTACTCAAGTTGAATGTGC |
| | AGCCATGCATGGCCGGTTTGAAGAAGTCACATTCCAGTTTAATGCAA |
| | CAGATTTTTATTCATATGTAGAAGAGGAGGCTCCTACAATTTCAAGC |
| | GGATCATCAGATGTTCTTCATCACGATTGGGTGAATGGAGAGGATCC |
| | AGTTTCACCTATATCTTTAATATCACATGGTTCAGGGATTAGCAATT |
| | TTGAAGATCCCCAAACTTGTCTAATATCCTCAGGTACTGGTAACAAA |
| | GAGGATGTAGTTCCAAGCAAACCTGCAAAACCTCCAGAAACTACAGG |
| | ATATGTTGGTAACTTTGAAGAAAGTTGGAGCAATGGATTGTCTGAAG |
| | GGTTCAGTCCTGTCACTGACTCTAATTGTCTTAGCTCAGTCCCCAAA |
| | CCTATGTTCCATCCTCAATCACCATCATCAGTCAATATTTTATCTGA |
| | TGAAGATGAAGATTCCACCAGCAGAGAGTTGCGACTTTTAGCAGTCA |
| | AACATCAGAAGGAATTAATGGAACTTCAAAGAAAACATGAGCATTCC |
| | CTCCTTAGGAATTGAAAATGAATTGAAAAACAGAACACCTTTGGGAAC |
| | ATCTTTAGATATGAAAAATTCCAGTCCTGGAATAAATTTTCAGGATC |
| | AGAAATTGAACGTGAATGGCAGCGAGAGCAGCGGGAAGATGACTCG |
| | GTTAGACATGGTACAACTGGTAGGGATAAGGAGTTTGTAGCCATGAA |
| | ACAACTTGGATCCGATGCTCGGGGAACAAGGCTTTCCAGCAGTCCCA |
| | GTCATAGATTATCACCGATGGAACCAGCAGTCAGTTCTGATCTTCCA |
| | GGTCCAAGTAAACTTGCAATGCATTCTTCTACTCTCCCTTCTGTTAG |
| | GCCAATTAATAGAAATATAGCACCAAATCAAAGGCTAATGAAAATGC |
| | ATTCTTTTAGTGGTGTTGACAGTCAGCGTTCTATTAATTCTCTGGCC |
| | AAAGAAGTTAGTAGGCAGAAAAATTACCAGACAATTGGAGCATTTCG |
| | AACAGGAAATGTCGATGAAAAGAAACATAGTCTTGAGGGGATGAGAC |
| | GATTTCCATCTATATCTCAGAAATCTTCTTCAAGGAACTGCAAGGAA |
| | GGTAAAACTAAAATAGTCTGAGAGAACTGAAGCACACTTGTAACATA |
| | AATTTATTGCCCTTAGTTTAGAATATAGATTGGATACTGCACTGAAA |
| | ATTTATCAATTGTATATATGAGCTTTACCTTCTGGAAGAGGTAATGG |
| | TTGGTGGTAATGCTATGCAAGGTTCTTCGGAAATTATTCCTTCGCCT |
| | TGGCACCTTTATGGTCTCCCAAGAATTTTGGTAGTAAGGGCAGCATT |
| | TTGAAATTATACAGAAACAAAGGAAAAATGTATGCATCGTCTTTCAT |
| | TAGGAGAGGCTGCAACTGCCACGGGCTACTACATTGTTGACATGTAC |
| | TATGGATTCACCAGTTCAGCTGATGGTACAATTCAGATGAATTTGTG |
| | GGTTATAATCCAAATAAGTGCTTCTTGGCTGGATAGAACCCAATTCC |
| | TCACCAGCTTTTCCAGTTAACAGAGAATTCATGTTTTTATGGCCTTT |
| | TAATTTTATGTCAAGCTTCTGGGAAAATTTGTATCTTTGTAGTATTC |
| | AAGATTTTACGGAGAGCATAAGCTATAAAAGCAAATCGGTCTGCAGT |
| | GTATTATCGACATCCCATTGTTTTCAGAAATCGATCAATAAGATAAG |
| | GCGGATGCAGACTAGAAGACATGCAAGTATTGCATGTCTAAATGGCT |
| | TGATTTTCTCATCAAAAAAAAA |
| 135 | ATGGGATCGGGCATCATGACGGAGACTCTTACAGATTCATGGCTAGT |
| | GGGCTTGCTCTGTTTAGTGCTGGGCTTCTTACTGCTTCAGCTCTACA |
| | AATTAGTGTGGGGGGCGAGCAGTCGAGCCTATAAGTTGCCGCCGGGT |
| | TCTACAGGGTGGCCACTGATTGGAGAAACCATCGGCTTCTTTCGAGG |
| | TATTATTCCACTGCTCAACCACGCCAGTTCATCCAAGAGCGAGAGCG |
| | AAGGTATGGGGAGATATTCAGATCAAATTTGTTTGGAAGATCTCGAA |
| | TTGTTGTGTCCGTGGATCCAGAATTCAACAACATGTCCTGCACACGA |
| | AGGCAGGCAATTTCAGGCCAACTATCCCAAACCTCTTCGAAATCTCA |
| | TTGGCAAATATGGGTTGCTTTCGGTACACGGAGATCTCCAGAGGAAG |
| | TTACATGGGGCGGCTGTAAATTTGCTGAGGTTCGAGAGGTTGAGCGT |
| | GGACTTCATGGAGGACATACAGAACCTTCTGCACATCACCTTGGCCA |
| | AATGGGAAGCCAAGAGGGATATACATCTTCAAGAAGAGTGCCATCAG |
| | CTTGTTCTGAATTTGATGGCCAAACAATTGCTGGACTTATCGCCATC |
| | CAAGGACACTGAAGAGATTTGTGAAGCGTTTGGCCATTTCTCTGAAG |
| | CTCTCCTCGCTGTTCCCATCAAAATCCCGGGTACCAAGTATGCAGAG |
| | GATTTAAGGCGAGGGAATTTTTGATAAAAAGATTTACGAGAGTATA |
| | GAGGATAGAAGGCAGCATCCAGAAGCTGTACATAATGATTTGTTAAC |
| | AAAACTCTTGAAAGAAGACACGTTTTCAGAAGAAATTATAGCAGATT |
| | TTATACTGTTCCTGCTCTTTGCTGGTCACAGACATCGTCCAGATCC |
| | ATGTCATTCGCTATCAAATTTCTCACAGACTGTCCCCGAGCACTCGA |
| | GGAACTTAAGGCTGAGCACGACGCTCTGTTAATGAGGAAGGGGAATC |
| | TAAAAAATCAAAAGCTCAATTGGGATGATTACCAGTCGTTGAAATTC |
| | ACCCAATGTGTCATACATGAAACACTTCGTGTGGGCAACTTTGGTCC |
| | AGGAGTTTTCAGAGAAACAAAAGAGGACATTAAACCAAAGGAGGCT |
| | TTGTCATTCCAAGAGGATGGACAGTGTATGTGTTTCTGACAGGCACC |
| | CATCTGGACGAGAAGTACCATTCTTCTGCACTCAAGTTTGACCCATG |
| | GCGCTGGCAACCGCATCTGCAAGATCAAGAGCTCTTAAAGAACCCCT |

TABLE 2-continued

Cell Signaling Gene Sequences

| SEQ ID NO | Sequence |
|---|---|
| | CGTTTATGCCTTTTGGAGGAGGTGCCAGGCTCTGTCCAGGAATGCAT<br>CTGGCAAAGATGGAGCTGGCCCTCTTTCTTCATAACTTCGTCACCAA<br>ATTCAGATGGGAGGCACTGCAGGATGATAAGATCTCCTACTTTCCTT<br>TTCCTCGCTTGATCAAGGGCCTCCCAATCCGACTACGTCTTCGAGAG<br>TGACTAGACGATTAATGTAGGATTTAATTCATGCAGGCTGGAGTTAA<br>AAGAAAACTATATAGAATAAAATAATTGCCATGATGTGGACGCTAGT<br>TCCGATCTAAATAGCCTGGGTTTGTGTGAGTAGATTTCAGAGATATT<br>TATATTAGCTTTCCTTGTGTATCAAATCGTCGAGATTATCTTCCTCT<br>TTGACTTTTATCGAGGAAGACAAATCTATTATTTTATTATTAATAAT<br>TTTGAGGTTTATCAAAAAAAAAA |
| 136 | GGGGAATGATCGTTACGGCCAACATAAAGGAGGGAGTGGCATTAGCA<br>TTCAAACGGGTAGCAGTTGTTCTGTGAAGAAAAACATTGCAATGGCA<br>ATAATGGGGGAAACCCTTCATTCGTTGCTAGTGGGCCTGGTCTGTTT<br>TGCGCTGGGGATGTTACTGCTTGAGCTCTACAAATTAGTGTGGAGGG<br>TGGACAGTCGCAGCTATAAGTTGCCGCCCGGTTCTACAGGGTTGCCA<br>TTGATTGGAGAAACCATCAGTTTCTTCCGAGGCATTAATTCCACTGA<br>TCAACCACGACGGTACATTCAAGAACGAGAGAAAAGGTATGGGGAAA<br>TATTCAGATCAAATTTGTTTGGAAGATCTCGGATTGTTGTGTCCGTG<br>AATCCAGAGTTCAACAAACATGTCCTGCAGCACGAAGGCAGGCAGTT<br>TCAAGCCAACTATCCCAAACCTCTTCGAAATCTTATCGGCAAATTTG<br>GTTTACTTGCGGTGCACGGAGATCTCCAGAAGAAGCTCCACGGGACG<br>GCTGTAAATTTGCTGAGGTTCGAGAGGCTGAGTGTGGATTTCATGAC<br>GGACATACAGAACCTTCTGCACACAACCTTGCCCAAATGGCAAGCAA<br>AGAGGGATATCCATCTTCAAGAGGAGTGCCATCAGCTTGTTCTGAAT<br>TTGATGGCAAAACAATTGATGGACTTATCGCCTTCCAAGGAGACCGA<br>GGAGATTTGTGAGGCGTTTGGCCATTTCTCCGAAGCTCTCCTCGCCA<br>TTCCCCTCAGAATCCCGGGAACCGCGTATGCCAGAGGATTTAAGGCC<br>AGGGAATTTCTGATAAAAGGATTTATGAGGGTATAGAAGACAGAAG<br>GAAGCATCCACAAGTTGTCCGTAATGACTTGTTAACAAAACTTTTGA<br>AGAAGACTCGTTTTCAGAAGAACTTATAGCAGATTTTATACTATTCC<br>TGCTCTTTGCTGGTCACGAGACCTCGTCCAGATCCATGTCATTCGCT<br>ATCAAATTTCTCACAGATTGTCCCAAAGCATATCAGGAATTGAAGGC<br>TGAGCACGACGCTCTGTTACAGAGAAAAGGGAATCGAAGAAACGGAA<br>ATCTCACTTGGGATGACTACCAGTCGATGAAATTCACCCAATGTATC<br>ATAAATGAAACACTTCGTCTCGGCAACTTTGCTCCAGGGGCTTTCAG<br>AGAAGCGAAGAAGACGTTAAACCAAAGGAGGCTTTGTGATTCCAAAA<br>GGATGGACGGTGTATGTGTTTCTGACGGGAACCCATCTTGACGAGAA<br>GTACCATTCTTCTGCTCTCACGTTTAACCCATGGCGTTGGCAGCAAC<br>TTCCTTCAGATCAGAGCTCTCAAAGAACCCCTCGTTTATGCCTTTTGG<br>GGGAGGTGCCAGGCTCTGTCCCGGAATGCATCTGGCAAAGCTTGAGC<br>TGGCTCTCTTCCTTCATAACTTCGTCACCAAATTCAGGTGGGAGGCA<br>CTGCAGGATGAAAAGATCTCCTACTTTCCTTTTCCTCGCTTGATTAA<br>AGGCCTTCCAATCCGTCTACATCCTCAAGAGCGACTCGGCGATTAAT<br>CTCATTGAGATAGGATTTAATTCATGCAGCATAGATAGGATTTAATT<br>CATGCAGCATGGAGTGTTAAAAAGACTAGATTTACTTGAAGGATAGA<br>GCACTTGGCACCCTGCGGACACAAGTCCTAGGTTTAATCGCATATGT<br>TGGCGTGACTAGATTTGAACGCTATTAATATGGCTTTTCTTCTGTCT<br>GGATGTGTAGGGATTAGTCTTCACTTCCCCTCTGATTTTCATGGAGG<br>AAAACTACTGAAAGTGCTCAGTGACATTAATTACTTGTTTTTAATTT<br>TTTTAAAGTTTTGTTTGGTTTTGTGATCTAATAAGTTATTAAGATTA<br>CTTTTAAAATTTTGTATGGTTTTTAAGAGCTACAATGTTA |
| 137 | GCTACTTCCGAGGACGCGGACGAGGAGAAAGAAAAGAGTTTGGAGGT<br>CCCGGGGATTAATTTCTCTCCGCGCATCGAAAACGAATTTCGCCTGC<br>TTCTGCACAGATCCAGGTTCGAATCCTCGGGGCTTCAAAGAGGATTC<br>GGACGGACTGAAATGCGAGCAGGAGAACAGGAGCATCATCACACATA<br>TGGGAGGGACGGTAGTAGATAGCGTCCGTAGGTGGTATCAGCGTCGC<br>TGGAGTCATTCTTCAAGCGCTCACGAATCAGGAAAAGAGAAACAAAC<br>AGTTGATTCCCTCTCTTCTTCTTCGGTCTCTCCATTACCTGTGGAAA<br>CCAAGGCGGTGGAGGGCCGTGGCTTGAAGCCTGTGCGCGTGCAGTTG<br>AGAAGCAAAATGACCGGGCCCGATCGCTCCAGGAAAAGCTCGCTGGA<br>GACGGAGTTCTTCACCGAATATGGTGAAGCiAAACCGATACCAGATA<br>CAGGAGGTTGTTGGCAAGGGAAGCTATGGTGTAGTAAGTTCTGCGAT<br>TGATACTCATACTGACATTGTTGAGATTAAGCACATTATGCTTCCTC<br>CATCTCGACGGGAATTCAAAGATATATATGTTGTATTTGAGTTGATG<br>GAGTCTGATCTTCACCAAGTTATTAAAGCAAATGACGATCTCACACC<br>TGAACACTATCAGTTCTTTCTGTATCAGCTTCTTAGAGCTCTAAAGT<br>ACATTCATACAGCAAATGTATTTCATCGTGACTTGAAGCCAAAAAAC<br>ATTTTGGCAAATGCTGACTGCAAATTGAAAATATGTGACTTTGGGCT<br>TGCTCGTGTCTCCTTCAATGATGCTCCATCTGCCATTTTCTGGACGG<br>ATTATGTGGCAACCAGGTGGTATCGAGCCCCTGAGCTTTGCGGTTCT<br>TTCTTTACTAAGTACACTCCTGCCATTGATATCTGGAGCATAGGATG |

TABLE 2-continued

Cell Signaling Gene Sequences

| SEQ ID NO | Sequence |
|---|---|
| | CATATTTGCTGAAATGCTTACAGGAAAGGCATTGTTTCCTGGGAAGA<br>ATGTTGTACATCAACTGGATATCATGACTGATTTGCTTGGCACTCCG<br>TCAACAGAAACACTTTCTAGGATCCGCAATGAGAAGGCCAGAAGATA<br>CTTAAGTAACATGCGGAAAAAACAGCCAACACCCTTCTCACAGAAGT<br>TCCCAAATGTAGATCCACTTGCTCTTCGTCTGCTTGAGCGTATGCTT<br>GCATTTGATCCAAAAGACCGACCTACAGCAGAGGAAGCATTAGCTGA<br>TCCATATTTCAATGGTTTGGCAAAAGTTGAGCGTGAACCTTCAACGC<br>AGCCTATTTCAAAGCTGGAGTTTGAGTTTGAAAGGAGAAGATTAACA<br>AAGGATGATGTGAGAGAGCTTATATATCGAGAGATTTTAGAGTATCA<br>TCCTCAAATGCTACAGGAGTATCTATGTGGTGGCAACAATGCCACCT<br>TTATGTATCCAAGTGCTGTAGATATGTTCAAGAGACAATTTGCTCAT<br>CTAGAGGAACACTATAGTAAAGGTGAAAACAGCACACCCCTTGGGAG<br>GCAGCATGCCTCTTTACCAAGAGAGCGTGTCATTGAATTCAGAGAGA<br>ATCCTACAAAGCACAGCAAGGATTCTGAAAAACAACAAGAAAGAATC<br>ACTGCGTCTGTAACTAAGGCTACCCTTCAAAGTCCACCAAGAAATCA<br>GGGAATTGTGATTGATTCTGCAGTTTCACTATCTAATGGTCCAAGTA<br>GAGCAGTTCCAGATCCACGAAACCTAGTGAAGAGTGCTAGCATCAAT<br>GCTTCCAAGTGCACAGTTGTTGTCAATTCCTGTCAAAGAAGAAATTC<br>CACAATGAAACCTGGGGATGAGAAAAAGGAGGACTTGAGCAGTGAAT<br>CGAGTGCTGTCACATACAATACAGATTCAATGGTTGCTGGTTTGACA<br>AGTAAGATTGCTGCAATGTCCAGTGGAGTGGCACATTCATGAATACT<br>TCATTGTGTTCAATCATTCAGGGCAGTGGTTACTAACCTCTAACTGA<br>TTTGGTTACAACATATTCTGAAGTGTCCTAAGCCAAGCATAGACTGA<br>ATGGCTGCTGGCCTGGTAAAGAAGGTTACAGCGATACCTAGTGGTTT<br>GCCTTATTTTCATGAATATGTTAATGGTCATCTAATTTTTATATTGT<br>ATCGATTGTGACCTGTTTAAAAAATATATTTTACTTTAACTGGCTTC<br>TTTTGTGTAATCAATAATTAATCTGTCTCAGTCAAAAAAAAA |
| 138 | GTGGCCTGCCTTCCCAAATTGTACAATCATTTTAAACCCAACATCCT<br>ACAAATAGGATCATTTGGAGCGTCATTTCACTCGGTTTTTCTCTTTC<br>AGTTTGAAGCGGTGGAGAAATGGTCTGTAGGCAAACTAACCATTTCT<br>GAAGAGCAGGCCTTAGAATTGTAGGGTAATTTGCAGTGGACAAGATG<br>GCTTACAGAGCAGATGATGACTATGATTATCTCTTCAAGGTGGTACT<br>GATTGGGGACTCTGGTGTGGGCAAGTCCAATCTGCTGTCGAGATTTA<br>CTAGGAATGAGTTCAGTTTGGAGTCCAAATCCACCATCGGAGTGGAG<br>TTCGCGACTCGGAGTATAACAGTCGATGATAAGGTCATAAAAGCTCA<br>GATTTGGGACACAGCTGGTCAAGAAAGATACCGGGCCATAACAAGTG<br>CATATTATCGAGGAGCAGTTGGTGCACTGTTAGTTTATGATGTAACT<br>AGACATGTAACCTTTGAGAACGTGGAGAGATGGCTTAAGGAGCTTAG<br>AGACCACACTGATGCCAATATTGTCATAATGCTTGTTGGTAACAAGG<br>CTGATTTGCGCCATCTTAGAGCTGTTTCTATAGAGGATGGAAAAGCA<br>TTTGCAGAACGAGAAAATACATATTTTATGGAAACATCAGCTTTGGA<br>ATCAACAAATGTTGAGAATGCATTCACAGAAGTACTTAGCCAGATTT<br>ACCGGATTGTGAGTAAGAAAGCTCTTGATGTTGGGGAAGACCCAGCA<br>GCGGTGCCCAGTAAAAGGGCAGACGATACATGTTGGCAATAAGGATG<br>ATGTGACAGCAATGAAGAAAGTTGGGTGTTGTTCTTTATAAGCCCAA<br>AGTGCAGTGCTCTAAAGTGTTGTCGTCTGAAGCTTTTGCTTCTAAAG<br>CGATTCTTTTTGAGGAATTGATTTAATGTCAAAAGAAGGATTGATGG<br>TTGCATGTCAGTTTTAAGAGACAAGCACCCTGCTATTGCTCTGTATG<br>ATTTATTAGTGAACTTTGCTGCTCTTGGATGCCTCCAAAGCGCATT<br>GTTGTCATATAGCTTTTGTTGCTACTATACGTTTTAGCAAATATTTC<br>AATGATTTGTATTGTGGTTATTTTGGACAGATCATGTCAAAAAAAAA<br>AAAAAAAAAAA |
| 139 | AAGTCTTAGTTGACTCCACCCACCCCTGGGCCAGCTTCGAATCTTTC<br>ATATGTGATAAATCAGGCGAGACTTACCATAAGTAAGCCTAAACGCA<br>TTTATATCAAAGTTTCACCTGAGAGTTCCCCAGTGGACACTTACTCA<br>AAATATGAGTTTATCAAAGTTCTACCTGTGGATTCTCCAATTCACCC<br>TTAATCAACCCATCCCAAAATAATTGGGAGTTTCTGAGTATCTAGGG<br>TGAGTGGGTGACTCCATTCATCTCTCTGACAGATGACAGATGAGGTT<br>AAGATGCTGTTGTTGGTGCTGCCGCTGCCATTAGCATTGGGTTTCGT<br>TGTGCTAGGCTGGAATCTGGATGTGGCCTTATTTTAATGAAGCCCCC<br>GTATCCCGATGGTCTTCACTCTCTCGGCCCCGCTGGGCATCCTTCAT<br>AAATATCTATGTTCGCTGTAACAAATTGCTCAGGCCTGTGACCAAGG<br>GGAAATGGAGCCCACGCCCAGCGCTCGTAATTAGCTCGAACTAAGAA<br>CCAAAGTGTGGACCATCTGACCATCCATCCATTCATTGCCTCTCCGG<br>CTCTGGAAGTTTGAGGGGGCGAGATTTGTCCACTAGACCAACGTGG<br>ATTCGGGATAGGCTGTTGTTTTCGAGAGATCTGAAACAGCGGGGCT<br>GCAGGAATGGAACTGGAGACCTCCTACTGAAGGCCAACAGTGCGAAG<br>GGGTTCGGAATGATGAAGAAGAGAGGGGATTCTTCGTCTTCATTCCC<br>AGACGAGGTGCTGGAGCACGTGTTGTTGTTCGTGGTTTCGATCAAGG<br>ACAGGAGCGCGGTTTCGCTGGTATGCAAGGCCTGGTACAGAGCCGAG<br>GCCTGGAGCCGCCGGAAGGTCTTCATTGGAAACTGTTATTCCGTCTC |

TABLE 2-continued

Cell Signaling Gene Sequences

| SEQ ID NO | Sequence |
|---|---|
|  | GCCGGAGATCTTGGTGAGGCGCTTCCCAAAGATAACAGGCATAACTC |
|  | TCAAAGGAAAGCCGCGCTTCTCAGATTTCAACCTCGTTCCTCCCCAC |
|  | TGGGGGGCGGATATTCACCCCTGGCTCCTGGTCATACGCGGGGCCTA |
|  | TCCATGGCTCCGGGAGCTGAGGCTTAAGCGCATGATCGTCACGGATG |
|  | AAAGCCTTGAGCTCATAGCGCGTTCCTTCTCCGATTTCCGCGCTCTC |
|  | TCGCTCACCACTTGCGAAGGTTTCAGCACCGACGGCCTCGCAGTCAT |
|  | CGCAACTCATTGCAGGAACCTGCAAGAGTTGGACCTGCAGGAGAGTG |
|  | AGGTAGATGATCGAGGCGGTTACTGGCTGAGCTGTTTTCAGAGAGC |
|  | TGTGTTTCACTAGTGTCACTGAATTTTGCTTGCTTGCAAAGTGAAGT |
|  | GAATTTTGATGCCCTTCAGAGGCTTGTGGCTAGATGTATTTCTTTGA |
|  | GGAGTTTGAAACTAAATAAAACTCTTTCTTTAGAACAATTGAAGCGG |
|  | CTTCTTGTAATAGCTCCTCAGCTGATGGAGCTGGGTACAGGTTCATT |
|  | TTTTCAAGAGCTCAGTGGTCCGCAATTTACTACAGATCTGGAAAATG |
|  | CTTTTAAGAACTGTAACAAACTTAGAACTTTGTCAGGGATGTGGGAA |
|  | GTAGCACCTCTGTATCTTCCTGCCTTGTATTCTGTGTGCTCAAACTT |
|  | GACATTTTTGAATTTAAGCTATGCGGCCAATATCCGAAGTATGGAGC |
|  | TGGGCCGTCTTGTTTCTCATTGTCCTCAACTCCGGCGGCTTTGGGTT |
|  | CTTGATACTGTTGGAGACAAGGGTCTGGAAACCGTATCATCAAACTG |
|  | TAAGAACTTGAGAGAATTGCGGGTTTTTCCATTGGATCCATTTGGCC |
|  | AGGATCGAGTTGGTGTCACAGAAAAAGGCATCCTTAAATATCTCAAG |
|  | GATGCCCTAATCTTAGTTATGTTTTGTATTTCTGTAGGCAAATGACA |
|  | AATGCAGCAATTATTGAAGTGGCTCAAAATTGCCCCAGGTTAACACA |
|  | TTTTCGCCTTTGTATAATGAATCCCTGCCAGCCAGATCATTTGACAG |
|  | ATGAACCTATGGACGAGGCTTTTGGAGCAATTGTAAAGATATGTAAG |
|  | GGATTACAACGATTGGCAATATCAGGTTTGCTTACTGATAAGGCTTT |
|  | TGAGTACATTGGTCTTTATGCAAAGAATCTAGAAACCTTGTCTGTGG |
|  | CCTTTGCTGGAAGTAGTGATTTGGGCATGGAATGTGTATTGCGGGGA |
|  | TGTCCAAAGCTTCGGAAGCTTGAGATAAGGGATAGTCCATTTGGCAA |
|  | TGCTGCCCTCCTATCAGGTCTTGAACAATATGAATCCATGCGTTCAT |
|  | TATGGATGTCTTCTTGCAAGGTTACGATGAGTGGTTGTAGATACCTT |
|  | GCTCAGAACAAGCCCAGGCTTAATGTGGAAATAATAAAGGAAAACGA |
|  | TGAAGATGACAATGATGCAGACAAATTATATGTCTATCGGACAATTG |
|  | CTGGGCCAAGAAGGGATGCTCCAAATTTTGTGCTCACCTTATGATCA |
|  | GATTCTTCTTTTCATCGTTATGGACAGTCTGGTTAGCTGCCTGGATT |
|  | ATCATGAAATGATTACAGGGAAGAATCATCTTGTATATATCTGTGAC |
|  | TTGCTCAACATGTAGGATGGGATACCTGCTGAATTGAGACACACCAT |
|  | TGTAAGGCAAGGCATCTGTCATTAGATGTGGATGACTGTTGGTTTTT |
|  | TCTCATTGGTGTGTACTATCCATTAAAGGTGGCACCACCAATTCGTC |
|  | AGATTTGAGTCCTTCGTTTATCGGACTCACAAGTTTCATTTCATAAT |
|  | AGGTCTAATCTTGGTTAACTTGTGAGTCCCTCGTGCCGAATTCGGCA |
|  | CGAGGACGGACTGTGCTGCTGGAAAACTCGTGTTTTCGTAAATGGTA |
|  | GGGAGCTCCATCAAAAAGACTTGGATTTGCTTGCTGGCAGAGGTCTA |
|  | CCAACCACAAAAGACAAGTATTACCACGTTGAGATCAGCGGAAGAGT |
|  | TGTGGATAAGGATACTAATAAAGAGCTGAAGAGTCTTGGCAAGCTTG |
|  | CACCAACGTAGGTCACCAGTTAATATGCATTCTTCTTTCAGAAATTC |
|  | AAGGAAGTAGAGCAAATTTTATTTTCCAGTATGTCAAATTTGGCTTT |
|  | GGGCTACCAGGTTTTTGTAAATTGATGTTTGAAAAGTTATACATGTT |
|  | TTTCAATGCATTTCCGGGCAATAACACTTCTCGTGCCGAATCGGCA |
| 140 | CATAACTACAAACCGTAACGCATGCCTGGAGCAGTGTCCATAACGTC |
|  | AGTACGGTCGTGAGCAGCAGGAAACTTTTTCCGTGCTCCTTCTCACA |
|  | TCTTCTTGTTTGCTTCGGGATTCGATATCCTGACCACTTTACTCATC |
|  | AGCCCGCTGAATTCTTCTCTAGACTTGCTCTTTTCCTGTCATTGAGG |
|  | GCCAACACAGCCAACGGCTTCGTTCAAAATCGGGCCACAAGAATGGT |
|  | CGATCACTCGCTCATTTACAGTTTTGTTTCGAGAGGGACGGTCATAT |
|  | TGGCCGAGTACACGGAATACTGGGAATTTTCCCACCATAGCTTTCCA |
|  | GTGCCTCCAGAAGCTCCCGGCCACCAGCAATAAGTTCACATTTGACT |
|  | GTCAACACCACACCTTTAATTATCTCGTTGAAGATGGATTTACATAT |
|  | TGTGTCGTGGCAGATGAATCAGCTGGAAGACAAGTACCGATGGCCTT |
|  | CCTGGAGCGCATTAAAGATGAGTTTAAGAAGACGTATAGTGATGGAA |
|  | GAGCTGAAGTAGCTATTGCCAACGGTCTTCACCAGGAATTTGGGCCA |
|  | AATTGAAAGAACACATGGACTATTGTGCACAGCATCCAGAACAGATC |
|  | AATAAGTTAGCCAAAACCAAGGCTCAGGTTGCAGAGGTCAAAGGCGT |
|  | TATGATGGACAATATTGAAAAGATCCTTGATCGTGGTGAGAAGATAG |
|  | AACTGATGGTTGATAAAACAGAGCAACTTCAATTCCAGGCTCAGGAT |
|  | TTTCAGAATCAGGGTGCTAAGATACGCAGGAAAATGTGGTTCCGGAA |
|  | TACAAAAGTCAAGCTAATTTGTCTTAGTTTCTTGCTTTTTGTAGTTC |
|  | TCATGATATGGATCTCTCTATGCCGTGGATTCAAATGCCATGTCTGA |
|  | ACTAATAAGTTTGTAGCTATCAACATGACTAAGCTTTAGTGAAGGGC |
|  | TATACAATGCATCTTTATTCTTCTATTGTTGTTCTCTCTACATGTAA |
|  | ATGGTGTTTGCTGGAAAGGTAATTCTTTTTCCTGTTTCTTCAGAGTA |
|  | AAAAAAAA |

TABLE 2-continued

Cell Signaling Gene Sequences

| SEQ ID NO | Sequence |
|---|---|
| 141 | CTGCAATGTCCGGTCTCATCCTTTTTCAATCAATTCCATTGCCATTT<br>CCCTCCCAAACCCAAAGCATAGGGTTTCCTTCATCTCGGCGGATCTC<br>GAGTTCAATCCCTTCTGCCCATGAATTTTTGCCTTTTTCGATCCCAT<br>AGTTGAAGCTCGACGCAGGACGAACAGATCGGGGCAATTAACATACT<br>TATTCATTCGGACTTTCATTCGCTTCAAACATCGGTGGTTCGAACGC<br>CGGGGCGTCTGGATATAGCAGCAAAAAGATTACGCAAAGGCAGCGGC<br>TCTCATGGCGATACTGTATGCCCTGGTAGCCCGTGGTTCCACAGTTT<br>TAGCGGAATTTGACGCGGCTCACGGCAATGCGAAAACCATAGCGCGT<br>CAAATTCTGGAGAAAATTCCAGGTACCGGGGACAGCCACGTCTCTTA<br>TTCGCAGGATCGCTATATTTTTCATGTCAAGAGGACTGATGGATTGA<br>CAGTTCTATGTATGGCTGACGATACAGCCGGAAGGAGGATTCCTTTT<br>GCATTTCTAGAGGATATTCATGGAAAATTTGTGAAGACTTATGGTCG<br>AGCTGTTCATACGGCACTTGCTTTTACTATGAATGATGAATTCTCAA<br>GAGTCCTGAGTCAGCAGATGGATATTATTCAAGTGATCCAAATGCAG<br>ACAAGATTAATCGTATACGAGGAGAAATGAGCCAGGTTCGCAATGTA<br>ATGGTGGAGAATATTGACAAAGTACTCGAGAGAGGTGACAGATTAGA<br>GTTGCTGGTAGATAAGACTGAAACGATACAAGGGAATACTTTCAAAT<br>TTAAGAAGCAAGCTCGTCGTTTCAAAAATACAATGTGGTGGAGAAAC<br>ATCAAACTCACGGTCGCAGTGATAGTCGTGCTTTTGATCGTCATCTA<br>TGTCATCCTCGCTATAGTTTGCAAAGGTGTTACACTACCGTCCTGCA<br>GAAAGTGAATCGAACCGTTTGAATTTGTGGTCAGTGTCGTGTGTATT<br>TTTAGAAGGCACAAAGGTTTTTATTTTGGGAGGCTATTGGTTAATAC<br>ATATAAAGGGTGGTAAAGCGCTGTTCATATTTTTCCTAGAAGTATTG<br>GTCATTTTCTGTGTAAATTAGATTCATTGCCGTCAAAGAAATGAAGA<br>TTATTTGGAACATGAGGAAACATATTTTTTTCCAGGCTTTGAGCACA<br>AGCATTACTCTTATGGTAATGACATGGCATGGAAGATTAACAAACAT<br>GATTTTTATTATCTATATTTATTCTGTTATCAGTTCAAGCACTCGGA<br>ATATTTGTTCATGAGCCTTTTTCATTTAGTTTGGAAGTGATCATTTG<br>TAACAGTTTTTTGACACTTTTGAATTGTTTTGTAAGATGTGCCCATC<br>TACTTTATCGGAAGAAGGGAGACACTCTTACTCATCTTTGGATATTT<br>TCAGTAATTTTTAATAATAGATCAGAGAGTTCAAGATGGATTAAAAA<br>AAAAA |
| 142 | GGAAGAACTTTGCGTTTCCCTGCATTTCTACTTGTACCCTTATTCAT<br>TCATTCAAGAAAAGAAAAGGGCAATGGCTGTAGTTGCTTCCAATTCT<br>CTACAACTGCAGCGTGAAGAGGAGGCAGAGACGATGATATCAGATCA<br>ACAGCAAGAAGCTGGGGCGGAGATAATGGCATCAGAAGAAGAGTCGA<br>TTATGGAACCAGAAAACCCGTCATTGTCTCATCCCAATATTGTGTCC<br>AGCTGCGGGATGAGGTTCCAAAAGTACCAGAGTGTTTGGATTGACGC<br>CAACTTAGTCCCCGCAGTGAATTTCATCCAAAACGAATTTCAACCAC<br>GCCCCGACGACATTTTTTTCGCTTCCCTTCCAAAGACTGGAACCACA<br>TGGGGTAAGGCGTTGCTGTATACCATCTTGGAATTTACTTCCACAGG<br>CAATAACCCTCCAGCAAGCCCGAATGGTAATTCTGCTGCGGATGAGA<br>AAAGATTTGGTGTGGATGAGAAAAATCCGCATGCTTTGGTCCCAACC<br>ATGGAAAACTTATCTCTTCAATTCAAGTGACAGCGAACAGTATGATA<br>TTTCCTGCTTCTCTGATTTTCCGTCTCCGCGTGTGCTCCACACACAT<br>TTGCCAATCCATACGCTGCCTCTTCTTGTGAGATCTTCTCCGACTTG<br>CAAGATAGTTTACATTGCCCGCAACCCCAGAGATTCCTTCGTTTCCC<br>TTTGCCAATTCTACGCCAGACTTCGCGGAGCGGGGTCTCATTATTTG<br>GACGGAGATCTCGGCAAGGAAACGGTGTTTGATGCATTTTGCTCTGG<br>CTTCTACTATGGCGGCCCCTTTGCCGAGAACGTTCTGAGTTACTGGC<br>ATGAAAGCAGGCGCAATCCGAATCAGGTGATGTTTGTGACGTACGAG<br>GACCTGCAGGCCGATTGCGTGGGATGGGTTAAAAGAATGGCTCTTTT<br>CTTGGGTTGCTCTTCTCCTCTTCTGGAAGACAACGCCCAGATAATTG<br>CAGAAAAGTGCAGTTTCGATACCCTCTGCAATCTGCAGGTGAACAGA<br>AAAGGAAAAGTGGGGACGCTTAAATACGGAATGAAAAACGCCTTCTT<br>CTTCCGCGAGGGCAAAGTGGGCGAGTGGAAGAAGCATTTTACGCCAC<br>AGATGGAGGAGCGTATTTATTTAGAGATCGAGCAGAAATTGAGCGAT<br>CAAGGCCTTCGTTTCACTAATAGCTTGTAGAAAGCCATTTCGTTTGT<br>GTTGAATTTATATTAGCTAGATAGCTATCAGGTCCTCGGATTCTGAA<br>ATCTTCCTGAACTCTACAGTTAAGATAAAGAAGTCACATCCATTTCC<br>ATCTACTTATTACTTTTATTGACCATCAGTTGCAGTGAAGTTCCTTA<br>GTGCAATAAAAAAAAAA |
| 143 | TTGGGTTCGGGGTCCTGTCCTGGACTGGGAATTTTTGTTTCACTCGT<br>TCTGCCCCGTCTGGATTGGGCTGCACTGAAATACATTGAACATTGGA<br>GTTGTCGAGCGCGAGATATGGGTCAGCAGTCCCTCATTTACAGCTTT<br>GTTGCAAGGGGCACGGTGGTCTTGGCCGAGTACACCCAATTCACGGG<br>CAATTTCACAACAATTGCCAATCAATGCCTTCAGAAGATTCCTGCCA<br>GCAATAATAAGTTCACCTACAATTGCGATCGTCACACATTCAATTAT<br>CTCGTCGAAGATGGTTACACATACTGTGTTGTTGCAGATGAATCAGT<br>TGGAAGACAACTACCAATTGCCTTTCTGGAGCGCATTAAGGATGACT<br>TCAAGAAACGATATGGTGGTGGAAAAGCTGACACAGCTGTTGCTCAC |

TABLE 2-continued

Cell Signaling Gene Sequences

| SEQ ID NO | Sequence |
|---|---|
|  | AGCCTCAACAAAGACTTTGGACCAAAATTGAAAGATCATATGCAGTA<br>TTGTGTTGATCACCCAGAAGAGATTAACAAACTTGCAAAAGTGAAGG<br>CTCAGGTTTCTGAAGTTAAAGGCGTAATGATGGAGAATATTGAGAAG<br>GTCCTTGATCGGGGTGAAAAGATAGAACTTTTGGTTGACAAAACAGA<br>GAACCTTCGATTTCAGGCTCAAGACTTCCAGAAGCAGGGAACACAAC<br>TTCGCCGAAAAATGTGGTTTCAGAACATGAAAGTCAAACTGGTTGTT<br>CTTGGAATTGTCTTTGTGTTGATTCTTATAATCTGGCTCTCAATTTG<br>CCATGGATTTAAGTGCCATTAATCTTGATTACTTGGCAGTCCTTTCT<br>AGATACAATCCTTTCGAGGCATTTATATTCATTTTTTGGCAGCTTGG<br>CTTATAATAGATGCAGGCTCTCTTTGAAAAGAGTATCTTTTGTGTTG<br>TGTCTGAGTAATGTATTTCATTCACTTGGATACTCTCATCATTAGAT<br>ACTGATTATCTATGTTTTTCTCTGACGAGGGACAATGCCTCGACTCT<br>TCATAGTTTAGGTTATTGGCACTACCCATCAGCTGTGATGTCAATCT<br>CTTTTATAAATATGAATCCCTGCTTTTGGTTTTCAAAAAAAAAAAAA<br>AAAAAAAAAAAAAAA |
| 144 | GCATATGCGAATAGCACATCAAATCGGGTTGCGACTGCCTGCCACGT<br>TCGATATCTCAGGCTCTTCGATGAAGCTGAGTGCCAGAATCAATTTA<br>ATAATCAATGAATAATAACAAGGGAAATTACTGTAGATTGCGAGACG<br>TTACAGTTTACTTAGGATGACCCCAATGATTTCTCATCTTTGCTTCA<br>ATTCAGTGTCGCAGAGGGTGCTCTTCCATGTCTGAAGAAAATGTGA<br>ATGATGCTCTGCAATACAAAATTTTCTCGCATTGTGGACGCGTGGTA<br>AGTGCAAGAACGAGTGAAGGGGAGAAGGGGGGTTTTGCCTGTAAGA<br>AAGGATCAGAGAGAGCAAGCATCCAGTAGCCATGGAAAACATGAGGA<br>AGAAGTTGGGGCCACTGTTCAACTCCGGGCAGAGTTTCCGTCCTGAC<br>ATCTCTGTTGATTCCTGTACTTCATATAAGGTAACAGCGGGTGGAAC<br>TTTACACTTGCTGAGTAATTCGTGTGGAGAATATAATATTAATGAAC<br>TTGGCTTACAAAAGCGCACTTCAGCAGGTATTGATGAATATGATACG<br>AATGAGAAAACATATCAGTGTGCTTCGCATGAGATGTGCATATTTGG<br>TGTCATTGGACGTGGTGCAAGCAGTGTTGTCCAAAAGGCTATTCATA<br>TACCAACTCATCGGATTTTAGCACTGAAGAAAATAAATACTTTTGAG<br>AAGGAAAAACGGCACCAGCTATTAAATGAGATTCGAACACTATGTGA<br>GGCACCACATGTGAAAGGCTTAGTGGAGTTTCATGGGGCTTTTTACA<br>CTCCTGCATCTGGACAAATCAGCATTGCTTTAGAATACATGGATGGA<br>GGCTCACTTAGAGATCTTGTGCAGTCAAAGAAGCGTATTCCTGAGCC<br>AATTCTTTCTGTTATTACACATGAAATTTTACATGGATTAATTTTTT<br>TACATCACGTGAGGCATCTGGTGCATAGGGACATAAAACCTGCTAAT<br>CTGCTTATAAACCTTAATGGAGAGCCAAAAATTACAGATTTTGGCAT<br>TAGTGTTGGTTTGGAGAACACCGTTGCAATGTGTGGCACATTTGTTG<br>GGACCGTCACATACATGTCACCAGAGAGAATTGGTAATGAATATTAT<br>TCATTCCCAGCAGATATCTGGAGCCTAGGACTTTCCATTTTTGAATG<br>TGGTACAGGAGAGTTCCCATACAATGCAAGCAAGGGCCCTGTGAATC<br>TCATGCTACAGGTCATAGATGATCCATCTCCCTCACCTTCACGAGAT<br>TGCTTTTCAGAGGAGTTTTGCTCATTTGTTGATGTCTGTCTACAGAA<br>GGATCCAACTGCAAGGCCTACAGCAGAACAGCTCTTATCACATCCCT<br>TTATTAAAAAATATGAAAATGCAGGAGTTGATCTGTCAGCATATGTA<br>CAAAGTATTTTTGATCCTATAGACCGTCTAAAGGATTTAGCTGATAT<br>GCTTACTGTACATTATTACATGCTTTTTGATGGCACCGATGATCAGT<br>GGCATCACATGAAAACTATGTACCGTGAGAATTCTGCTTTCAGCTAT<br>GCAAACCAGGTTGCAGCTGGAGCAAATGATATCTTTAATACTCTATC<br>ACGAATACATAGCATGTTGGTTGGTGATAGCCCTGATGAAAGGCTTG<br>TTCATGTAGTTGAAAATCTTCAATGCTGTGTATATGGGCAACATGGT<br>GTTGTGATCCGTGTATCTGGATCATTTGTTCTTGGAGGCCAGTTTAT<br>ACCAACTGGGGGTGGGGTGCAAGTTGAGGGGGTTTCACAAGGACCTT<br>TGTTGGACATAGCATCACAAAGAATGGGGACCTTTAATGAGCAATTC<br>ATCATGGAACCAGGAGAGCAGATTGGATGTTATTATATATATAAGCA<br>GGAGCTGTGCATCCAACAGTGAAAAAAATGCATACAACCAAATTGTC<br>TTTTTGCTTCCGTACAGTCTATATTCTCTGGTACAGGAGTGCTGTAA<br>AAAAGCAGCCCAAGAACAGGAAGCTTGTGAAGGGAGTTTCCATCATA<br>GCAGTTGTAGCAGGGGTTGGAAGATTCCTTGATGTTATAACTTGTAT<br>GCACCATGTATCACCATCAAAGAAAACCCACATCTGCCTTCAGATTG<br>ATTGACTGGGAAGTAAAACAGGCATGGGAGACAACTTACTGGAAGCA<br>GATGAACAGCTAATATTTCAGTGAAGATTTGCTCAAGAGATTATTAG<br>AGACTGATGAACTAATAACTCTAAACAGATCAATACATCACTGAAGT<br>TTGTGTTGCAACCCTCATGAAGATGGAGAATAGCCTATGCATATTTT<br>GATGCATCTATAGTTTACTAAATTTGGAATCTGTAGCTGTTGTGATG<br>GTGTTCTGATTAGAGTAGCTTTATGCAGCCTTGAGATAATTTTAAAT<br>GGCTGAGAGTTTTGTTGATAAAGAGGAAGAGTAATACTGTTGCCTCA<br>ATGACTGAATAAGGTAAAGAATTGTGATAGTTGGACAAAAAGGTTTG<br>GTAGTTTAAAGGCAAACACTTGCAGTTGTCATGGTATGGGCCTTCTT<br>AAAAGGTTGTTATCATGTCAGATGCCATTACTCGATGCTTTCTAATG<br>TTTGGTTAGTATAAAGATCTAAAAAAAAA |

TABLE 2-continued

Cell Signaling Gene Sequences

| SEQ ID NO | Sequence |
|---|---|
| 145 | AAACGCGGCCGATTTTACCGGACGGGCGAAATCACCATGATCGATAG<br>ACACAGTTCGAGGTGAATGGAAGCTTCGCCGTTGATCCAAGCCACCT<br>CCGTGGAGTGACGTGTATTGTCTTGACTTATAGCTGTACAAAAGAAG<br>AAGTATCGAGGAATCCGATAAATATAAAATTCAGGTTCAAATTCTCA<br>GGAAATAGCTTAAATTTCGCTTTCGATCGCTATCAGAGCCTTGAAAG<br>TTCAGAAAAGATTGAAACGCGGTCTTTTGGCAATTGAAGAAACGGAA<br>ATACTTCGGAAGGATTCGGTAATCCCGCACGTTTGACATTCTTAGGT<br>CAAGGCTTAAAGTTTTGTGGCTATGCATGGGGATAACTTGCTTTCAG<br>GTGATTGAAAATTGAAAATTTACTAAACTTTGATGGCTTTGTTTTGA<br>GGCTCGGCGAATTGATCTTTACGGTGCTTTATGTGAGAAATTCTGTG<br>GAAAAATCTGGTCTTCAGAGATCTTTAATGGTTTTTCCTGAAGAAAT<br>GATCATGCTCCAAAAGGATTCCACAGTTCTGCATTTCTTAGCTGAAG<br>CCTAACAGCTTTCCGGGTATGCATCGGAATATCTTGGTTTCATTTGC<br>TGAAAATTTTCAAAATTTACTGAAATTCGAAGGATTTGTTTTGAGGC<br>TCAGTGAGTTGATCTTAACGGTGTTCTTTGTGAGAAATTCTGTGGGA<br>CAAATTGGACTCGAGAGACATTTAATGGTTTTTGCTACAGAATTGTG<br>GAATTATCTCGTGTGACCTTAAAGGCTCTTGCGGTCTTCGTTCTTGC<br>ACGAATTTTGGCTAAAACTGCTGAAAGAAGTCCAGTTTCAACGCATT<br>TAAGAAAACTACTCAACATCGGTGAATTCAGTGGAGTCTTCCAATCG<br>AGGAGGCTGCAACAAGAAATTGTTCCTGCTGGGACTATTTATATCGG<br>CAAATTAACCGAAGTTGTGAGGATATGGAATTGGTTCGGAAATAGTT<br>CATTAGCGGGACAATTTGACAGGAATCATCAAGCTAAGCTTTTGCTT<br>GGAACGCTTATAAAATTTTCTGTTAAAGATCGGTCAATTTTGAACTC<br>CGGCAGATAAAGGTCTGGTTTGTGGTGTGGAGCGGAGGCGGCTGCTG<br>TTGCAGTTAAATCTAACGATCCGGTAATGGCCCAGACAGCCCAACCA<br>GCTTTAGATCCCAATATTCCCGGCGTTCTTACTCATGGAGGCCGGTT<br>TGTGCAGTATAATATTTATGGCAACATGTTTGAAGTTACCGCAAAAT<br>ATGTCCCTCCCCTATTTCCTATTGGACGAGGAGCATACGGTGTGGTC<br>TGCTCAGCACTGAATTCAGAAACCAATGAGCAAGTTGCATTAAAAAA<br>AATATCCAATGCCTTTGACAATTTAATAGATGCAAGGCGGACCCTAC<br>GAGAAATAAAACTGCTTCGACACATGCAGCATGAAAATGTTATTTCC<br>ATCAAGGACATAATGCTTCCCCCTCAACGAGAAGCTTTTGATGACGT<br>GTACATTGCATTGGAGTTAATGGATACTGATCTCCATCAAATTATCC<br>GTTCAAATCAGGCTTTAAGCGAGCAACATTGCCAGTACTTTTTGTAT<br>CAGATATTGCGAGGATTAAAATATATACATTCTGCAATGTCCTGCAT<br>AGGGACTTGAAGCCCAGCAATCTTCTTCTGAGTGCAAATTGTGATCT<br>CAAATAGCTGATTTTGGACTAGCCCGAACTACATCTGAAACTGACTT<br>CATGACAGAGTATGTGGTTACACGATGGTATAGAGCCCCAGAATTGT<br>TATTGAATTCACCAGATTATACTGCAGCTATTGATGTGTGGTCAGTA<br>GGTTGCATTTTCATGGAATTGATGAATAGGAAACCCTTATTTCCCGG<br>CAAAGATCATGTGCATCAGCTCCGTTTAATAACAGAGTTAACTGGTA<br>CCCCAACTGATGCTGATCTAGGTTTTATTCGGAGCGAAAATGCAAAA<br>CGACTTGTTCAGCTGTTGCCTCAACTTCCAAGACAATCATTAGCTGA<br>AAAGTTTCCACATGTACATCCTTCAGCTATAGACATTTGTGAAAGAA<br>TGTTAACATTTGATCCAACCAGAGAATTACAGTGGAGGAAGCATTAA<br>ATCATCCTTACCTGGGTAGTCTGCATGATGAAACTGATGAGCCTACC<br>TGTCCAGTTCCATTCAACTTTGACTTTGAGCAGTATGCATTGACAGA<br>AGAACGATGAGAGAGCTGATATACATGGAGGCTCTTGCATTCAATC<br>CAACTTAGAAGACTGAGTGGTGGTCTTTTTTCTTGTTTCAGATTGCA<br>CAACTGGTTGTTTGTTTGATATTAAGATAAATGTTTGATTTAAATT<br>TTGAGCTGTTATTCTCCAGTTGAGAAGCATGTTACCTTGCACAAAGG<br>AATCAATATATAAAACATAAATTTGATATTTGAACAGCAATATGCCA<br>GAACCTACTAAACTGGATGCTAAATGAGCCAGACGTTCCAAATAATA<br>GACAGTTAACTAACACCATTATTTAGTAAAAAAAAAA |
| 146 | GAAAGATGAGTGATCATCGGCCTGTGTCAAGGTGCCTAGAGAGGTAA<br>TGGGAATTGGAAATATTTATAATAGTAATGGTAATTGGAAATTGACA<br>GAGAGGACGCGTTAGGCTTTTAGGCAGCCATGAAGAGATGTGAGGGA<br>TGCTTCGAGGTCGGCAGGTTGGAGGCCCTAGGCGACGACATTCTGCT<br>GCAGGTTCTTGACAATATTACGAAACTCGAGACAGGAATTCATGGTC<br>TCTTGTCTGCAAACAGTTCTATCGACTCGAATCGGCCTACAAGAGGA<br>AAATCCGGTTGCTCAGAGGCGAAATGCTGCCAAGAATTCTCAAGAGA<br>TACCGAGCTGTAGAGCACCTGGACTTGTCCCTCTGCCCTCAGATCAG<br>CGATCAGTGCCTGGGGTTCGTGGCCGCAGCGGCTGGGTCTAGTCTGC<br>GCTCCATAGATCTTTCGAGGCTCGTCCGGTTTAGTCATCTGGGGCTC<br>TCCGTTCTGGCTAAGGGCTGCGAGAATCTGGTGGAGATTGATGTTTC<br>TTACTGCGCGAGATTTGGGGATATGGAGGCTGCTGCCGTTTCCAGTG<br>CCAAGAATCTGCAGACCCTGAAATTAGTGAGGTGCCAGATGGTTTCT<br>GACTTGGGTTTGAGCTTAATAGCCGTGGGGTGCAGGAAGCTCCAGAA<br>TTTGAATCTCAAATGGTGTGTGGGAGTTAGTGATTGGGTGTTGAGC<br>TCGTGGCTATAAAGTGCAAAGAATTGAGGTCCCTGGATGTTTCTTAC<br>TTACAGATAACAAACAAATGTATTGCATCCATCACACAACTTTTTTA<br>CCTAGAAACTTTTGTATCAGTTGGTTGTGTCTGTATAGATGACGAAG |

TABLE 2-continued

Cell Signaling Gene Sequences

| SEQ ID NO | Sequence |
|---|---|
| | GCCTTGCTTTGCTCAAGAATGGTTGCAAATCATTGCAGAGGCTTGAT
GTTTCGAAATGTCAGAGTATGAGTTCGACTGGTATAATTTCCCTTGC
AAACGGATGTATAGCCTTGCAGCAACTAAACTTAGCCTATTGCATCC
CTGTCACAAATGCTCTTCTTGCGAGCTTCGACAAATATGACAGCCTG
CAATCCATACGATTTGATGGCTGTGAAATTTCTAGCTCAGGTTTGAA
GTCTATTGGGAAAAGCTGCAAGTCTCTGATGGAATTGAGCTTAAGCA
AGTGTACTGGGGTGACAGATGAAGGAATCTCTGCACTAGTGGGAGGC
TGTACAGGGTTGAAAATTCTAGATATCACCTGTTGCCGTGATCTCAC
TGATGTTGCTATCACAGCTGTTGCAACATCCTGTGGAAATCTTTCAT
GTCTTAAGATGGAATCCTGTGCCCTGGTCACTGAGAGAAGCTTATAT
ATGCTGGGAGATAGCTGCCCCTTTCTAGAAGTACTAGATCTCACCGA
TTGTAGTGTAAGCAATACAGGACTGAAATCCATTTCCAGGTGCACTG
GATTGACTACCTTGAAACTAGGCCTATGCGAAAATATATCCAATGAG
GGTTTAACCCATATTGCTGCTCACTGTTCAAACCTCCAAGAGATTGA
TTTATACAGGTCTGTGGGAATTGGTGATACTGGATTAGCAGCACTTG
CCAGTGGTTGTCCAAAGCTCAGAATGGTCAATCTCTCATATTGTATA
GGTATCACAGATCATGGGCTGAAATCTCTGGCCCAACTAGAAAAACT
TTACAACCTTGAGATTCGGGGTTGCTTCCTTGTAACATCTGCAGGGA
TTTCTGCCATTGCCTCGGGATGTAAGCGTCTGGTAGAGTTGGATATC
AAGAGGTGCTACCGTGTTGATGATATGGGAATGATGACTGTAGTTCA
ATGTTGCATAAACTTGAGACAGATAAATGTTTCATACTGTCCAATTT
CAGATGCTGCCTTTTTGGCATTGGTGAATCTTAGTTGCTTGCAAAAC
GTGAATCTAGTGCATCTCAGAAATGTTTCTTTGGATGCCTTTGCATA
TCTTTTGCTAGCTTGTGAGAGCCTAAAGAAAATCAAGCTTTTGAAAC
AATTAAAATCCTTACTTTCATCCAATTTAATTAGACATGTAGAATAA
AGGCTGCAGAATCCGATGGGTGGAGAAGCCTCTTTTTATTTAATTGT
AGAAAATAGCTAAACTTTGATCCATGAAGACCTCTTAATCCATGGTG
AGAGCATGAGGTCTAATAAGTTCGGAACCGTGTATTCATCATCTCAA
AATTGCAAAAGAATTTTCAAGTCCTGGTTTTTTGACCAGAAATTTTG
TAAGGTAAGTTCTTGTCTATATGAAACTTTTTATTAGGATATTTAAG
TTTCAATGGGTAATATTAAGTTTCAATGCTAAAACTTTTTATCAAAA
AAAAAA |
| 147 | GTCAAGGGTTCGATCTACGCTCGGACATCTTTGGCTCTGTTTCCCTC
AGATTTCAGTGATGGAGGCCGCAGCAGCTCCAGTTCAATCGACGGAC
ACGCTCATGTCCGACGCGCCGCAGGCCGCCGGGTCGAATCCCATGGA
CAGCATCCCTGCAGTACTCAGTCACGGTGGCCGCTTCGTGCAGTATA
ATATCTTTGGGAATATTTTTGAAGTCACAGCCAAGTACAAACCACCT
CTGCTGCCTATCGGGAAGGGGCTTACGGGATCGTCTGTTCTGCAATG
AACTCTGAGACAAAAGAGCAAGTTGCCATAAAAAAGATAGCCAATGC
CTTTGACAATCGCATAGATGCAAAAGCGAACTCTTCGGGAAATCAAG
TTGCTCCGACATATGGATCATGAAAATGTAGTTGCCATAAGAGACAT
AATACCTCCTCCACAAAGAGAAGCCTTTGATGATGTATACATTGCAT
ATGAGTTAATGGATACTGATCTCCATCAAATTATTCGCTCCAATCAA
GGCTTATCTGAGGAGCACTGTCAGTACTTTTTGTATCAGATTTTGCG
AGGATTGAAATATATACACTCTGCAAATGTCCTTCATAGGGACTTGA
AGCCCAGCAATCTTCTACTGAATGCAAATTGTGATCTGAAGATATGT
GATTTTGGGCTGGCTCGGATTACTTCTGAAACCGATTTCATGACCGA
ATATGTGGTTACCAGATGGTATAGAGCTCCAGAATTGCTGCTGAATT
CTGCAGATTATACTGCAGCCATTGATGTCTGGTCAGTAGGCTGTATT
TTCATGGAATTGATGAACAGACAACCCTTATTCCCTGGAAGGGATCA
TGTGCATCAGCTGCGTTTATTGACAGAGTTGATTGGCACACCAACTG
AGGCTGACCTTGGATTTGTTCGGAGTGATAATGCTAGAAGATTTATT
CGGCAACTGCCACAGTATCCGAGGCAGTCATTTACTCAAAAATTTCC
TCACGTGCATGCATTAGCAATTGATCTTTGTGAAAAAATGCTGACAT
TTGATCCAAATCAGAGGATCACAGTGGAAGAGGCACTTGCCCATCCG
TACCTGGCAAATCTACATGATATCAGTGATGAACCCATTTGTGCCAT
GCCATTCAGCTTTGATTTTGAGCAGCATACCTTAACAGAGGATCAGA
TGAAAGAGCTGATCTATAGAGAGGCTCTGGTTTTAATCCAGAGTAT
GCACAGTAAAGTAACATTTTGTGCAGACAGTGGTTACAACTTTGAAA
ATTGGAAGCTGGGCTATTTTCTTGTTTGTAGCAGTCATAGTGTTATA
AATATTTATTGAGTTTTGGGAGCAATGTAAATATGTGTATTAAAACC
ACATTTGAGTCCAGGGCAAGTTGTAAGGGGGATAATGATTGAAGGGG
TGTAAAGCATTTATATTGGAGTATGTCAACCTGATATGCTACAACTT
GGTGAGATGCATTGTGCATGTATGAGTCACAGACCTGAACACTGCGG
TAAAACTGTATTATGCTTTATTCTTCTTTATCTTCAAACTTCAAGGG
GTTGTATGAAGATAATTTTTGTTAGAATATAAGTGAAGAAAAGTTGA
GTCTGGCAGTTTGCCACTTTTGTCTAATTCTCCTTTCAGATAAGTGA
TGAACTTGGACCTTTGGCTATTGTGTA |
| 148 | GTTGAAGAAGATAAAAAATGGCAAAGAAGCAGGCAGGGAAGAGCAAC
GATAGCACTGTGAATGACAGTGGAAGTGAAAATGAGACGAAGAAACC
CGCCGGTTCGAAGGAGGATGGGAGTATTCATTCTCCTCTGGTTGCAT |

TABLE 2-continued

Cell Signaling Gene Sequences

| SEQ ID NO | Sequence |
|---|---|
|  | ACGCCTCCATTCTCAGCCTTCTCTCATGTACCCCTCCATTCGTCATA<br>TTCCTGTGGTATACAATGGTTCACTTGGATGGATCTGCATCTCAATT<br>TTGGGATTTATGCAAGGAGCAAGGTCTTCAGGGTTTCCTAAGAATCT<br>GGCCAAAACCAACTCTCATAGCATGGAAACTAATTGCATCATTTGCA<br>GCTTTTGAAGCAGCACTCCAACTACTTTTACCTGGTGAAAGAGTAAC<br>TGGACCTGTTTCTCCTGCAGGAAACATTCCAGTCTATAAGGCAAACG<br>GAGTGCTGGCTTACTTTGTCACATTGACAACTTATATTGCTATCTGG<br>TGGTTTGGCCTATTTAATCCTGCAATTGTCTATGACCACTTGGGAGA<br>GATCTTCTCAGCACTTATCATAGGCAGCTTTATCTTTTGCATCTTTT<br>TATATATTAAGGGACATGTTGCACCGTCTTCGACTGATTCAGGCTCC<br>TCTGGAAATGTAGTTATTGATTTCTATTGGGGTATGGAGCTTTATCC<br>TCGAATAGGTAAAACTTTGACATCAAGGTCTTCACAAATTGTCGGT<br>TTGGAATGATGTCTTGGGCAGTTCTTGCAGTAACATACAGCATAAAA<br>CAGTATGAAGAGTATGGAAGAGTAGCGGATTCCATGTTAGTAAGCAG<br>TATATTGATGGTGGTGTATGTAACAAAGTTCTTCTTGTGGGAATCTG<br>GCTACTGGAACACCATGGATATAGCTCATGATCGAGCTGGATTTTAC<br>ATTTGTTGGGGATGTCTAGTTTGGGTTCCATCTGTATATACATCTCC<br>AGCAATGTATCCTTGTGCGTCATCCCATTAGTTTGGGTCTTAAGCTGT<br>CACTGGGCATACTTATTGCTGGCATTGCATGCATATTCATCAACTAT<br>GATTGTGATAGGCAACGGCAATTATTCCGTAAAACAAATGGGAACTG<br>CTTGATCTGGGCCGACCACCATCAAAGATAGAGGCTTGGTATGAAA<br>CCATGAGTGGGGAGAAGAAGTCGAGCCTTCTTTTGACGTCTGGCTGG<br>TGGAGTGTGTCACGACATTTTCACTATGTGCCCGAAATTCTTGCGGC<br>ATTTTTCTGGACTTTGCCAGGACTTTTCAATCATTTCCTTCCTTATT<br>TCTATGTCATCTTTTTGACAATCCTCCTATTTGATCGAGCTCAAAAG<br>AGATGACCAAGATGCCGAGCAAGTATGGCAAATACTGGGATATATAC<br>TGCAAGCAAGTTAAATACAATATTATTCCAGGAATTTATTGAGCAAT<br>TGGATAGTTTAGTTATGCTATGACTGGATTTCTCGGTCATTACTTAA<br>TGCAGCCTGTAGCTTAGTGGTAAGGCTGGTGACCACCGGCGTTCGTA<br>TGGCTTAATTGAGCATGTGAAAATATCGGAATCGGAAAAGCAGAATA<br>CATGTAGCAACATATATTTTCGAAAGCTCATCGAGCAGCTATAGAAA<br>CATTAATGCATGAAAGAGATCTAAATATTTAAAAAAAAAA |
| 149 | AAGATCAGTTCTGGTAGTAGCTCCAACAATGAAGTTCCCAGCTCCGG<br>CTAGGAATTTGTTGATAGTGTTGATAGTGTTTCTGGAGAGAATCCTT<br>ACCAGGTGTATGGTGAGTGATAGCTCAAATCATGAACCTCCAAGCTC<br>ATGTACTGCAACAAGGATCTCACCAGCTAGCTCTGGTATTATCAGTA<br>ACACAAAGCCAGCTGATTGCAGCTCGTTAGCTTCTTTGGATTTGCAT<br>GGGTCTATCTCCTTGCCTGGAACAGCAATTACAACCGAGGATTTTGG<br>AGGAATCTACCACCACAAGCCACTTGCCATTGTGCATCCTGCGTCTG<br>TGGAGGACATTGTGAAAAGTAGTTACAATGGTGAATGCTTCTCCTAA<br>TCTCACACTTGCAGCCATGGGAAATGGGCATTCCATAAATGGTCAGG<br>CCCAGGCCTTGAATGGGTTGGTTTTAGACATGAGGTCTCTCAAAGGA<br>ATTGAGATTTTCCAAGGAAGCCCAACGGAGGGTCCCTATGTCGATGC<br>CTGCGGAGACGAGCTGTGGATTGATGTCCTCAAGGCTACTCTTCGCG<br>TGGGCCTTGCTCCTCGTTCGTGGACTGATTATCTGCCTCTTTCTGTG<br>GGTGGGACACTCTCTAATGGCGGGGTTAGTGGCCAGACTTTTAAGTT<br>TGGCCCACAAATCTCCAATGTGTTGAATCTGCATGTTGTTTCAGGTA<br>AGGGAGAATCCATGACTTGTTATCCCGAGACGAATCAAGATCTCTTC<br>TATGGAGCTCTAGGAGGATTGGGGCAATTTGGTATTATCACCAAAGC<br>CAGAATAATGCTGCAGAGAGCTCCTCACATGGTGAGGTGGATAAGAG<br>CTGTATACGCAGATTTCGAGGAATTCAGAGCCGACCAAGAGCTGCTG<br>ATATCTTTACCAGAGGAGGGAACTTTTGACTATGTAGAAGGATTCGT<br>TTTGACAAACAACGATGACCCAATCAATGGCTGGCCCTCAGTACTAC<br>TCTCGCCCTCAAATTCTTCCTTTGACTTCAAGCTCATACCCCAGACT<br>GCAGGCCCAATGCTGTATTGCCTCGAGGTTGCCTTGCATTATGACCA<br>CGACGAAGATTTCGTCACTCTCAATAAGAGAATCGAGAGCATGCTAG<br>CCCCACTCAGATTCATCAAGGGATTGCATTTCAGCTTTGACTTGCCC<br>TACTTTGATTTCCTGAACCGGGTCCACGCTGCGGAAGTGGCAGCCAG<br>ATCGAGTGGAATATGGGATGCCCCCCACCCGTGGCTGAATCTCTTCG<br>TCCCCAAGTCCAAAATCTCAGCGTTTGATGCTAAAGTGTTTAGAGAG<br>ATTCTGAAAGATGGTGTGGGAGGACCCATCCTGGTATATCCAGTCAC<br>TAGAAACAAATGGGACTCTCGCATGTCTGCAATTATTCCAGAGGAGG<br>ACACTTTCTACTTAGTGGCTCTACTCCGTTTTAGTCCACCGTATCCA<br>AGTGGACCGCCAATTCAGAGCATTCTAGCACAGAATGAACAGATTCT<br>CCATTACTGTACAACTGCAGGCATTGACATGAAATTATATCTTCCCC<br>ATTATAAAACAGAATCTGATTGGAAAGACACTTTGGCAGGAAATGGC<br>AACAGTTCCTGCAAAGAAAAAGCAAGTATGATCCAAAGGCTATCCTC<br>GCTCCAGGACAGAGGATTTTTTCCAGGTCCACTGATTCAACAGCATT<br>CACACGCTTATACTCATCATCGTGAAGACCACTTTTGCCCACCAATA<br>TATTCCCAAAGATTCAATCAAGATTTCATTACCCTTTGTACAGTCCT<br>GAACCCCATCTTTTTAGCTTTACACAAACCATCCATTATTCGGTCCT<br>TGACTTTCTTTTTCTTGGGTCTGCGATTCAGACCTTTTCTCGTATGG |

TABLE 2-continued

Cell Signaling Gene Sequences

| SEQ ID NO | Sequence |
|---|---|
|  | ATGGATGCTACATTCAAACGGGCATATTCCACATGACATTCTCTTGC<br>ATGGAGTTATCTTGTTGACTATGCTGCAACTGTTTTAAGGTGGGATG<br>ATGCTGTAACATCCATCACAGATTTCCAAGGAAGGTTATTTTGCAGG<br>CAAACTGAATTTTGGCAGCTGCTGGAAGATGCAGTCGTGAATGATGG<br>GAGGGATCAATGCAAATTAGTACCATTCGACAGCTGCCACCTGCCCA<br>TTGTTTGATTCCACGTGGCACAGAAGCAACCACATACTAGAAAATTG<br>GACATCTTTTTTGGTTTATTGTAATTACAACCAGGTTCATGGTTGTT<br>GGCTGCAAAAAAAAAA |
| 150 | GGAAGTAAAGAGCCTCGGGTAAAGCCTCACACCATGTCACCTTAAAA<br>CGCTGACAATTGGAAAGCGTCACTATTAACTATTCAGCGCTATAATC<br>AGCTCAATGACGTGGCAATGACACGTAAATTTCAATGACGTGGTTAG<br>TCACCATTCGGGTAACATCGAAGCAACAGTACTCCGTGGGTTCTCTC<br>AATCAAAGACATCATTCTCAAGCAATCTCGAAATCCCTGCATCCATA<br>CCTAAAACCGTCGCATAACATATATTGTCCCCGTAATTTGTCACAGT<br>GGATATCCGGATAATTTGTCTCCGAGTGTCGATTGATTTACAGCAAT<br>ATGATGATTTTAAGTCTGGAATTCGGCGTCAGTGGTTATGATCAGGA<br>ACGGGTGAGAAAACAGCCCGGAATTCTCAGGCGTTAGGGCAAAAAAA<br>TGGCGGGGGAATTGACCCAAGCGGAGAAAGAAACCCTTGCTGCCGTT<br>AATGTCGGGGCATCGGCATTATCGTTTGCAGGATCGGCTTTCATCGT<br>GCTCTGTTATGTGCTTTTCAGAGAGCTTCGCAAGTTTTCGTTCAAGC<br>TGATATTCTACTTAGCATTATCTGACATGTTTTGCAGCCTTTTCAAT<br>ATACTTGGGGATCCAGGAAAGGGATTCTTCTGCTATGCACAAGGCTA<br>TACAACACATTTCGTTTGTGTTGCATCTTTTCTTTGGACAACTACTA<br>TAGCTTTCACTCTCCATCGTACTGTTGTGAGACATAAAACTGATGTT<br>GAAGAGCTCGGAGCCATATTTCATTTGTATGTATGGGGAACTTCACT<br>TGTCATGACAATTATACCTTCGATTGGTGATGGCTATGGGCAAGCGG<br>GTGCTTGGTGCTTGGTTAAAACAACATCAAGGGCTACAAAGGTCCTC<br>CAATTTATTACTTTCTATGCTCCTCTATGGGGAGCAATTCTATTCAA<br>CGGTTTCACATACTTTCAAGTTAGTCGCATGCTTAACAATGCCACTC<br>AGATGGCAGCAGGCATGTCAGATCGGCAACAACAAACCGATTCAAGG<br>GTTGATATGAAGGCAATGAACCGATGGGGCTATTACCCATTGATATT<br>GATAGGTTCTTGGACATTTGCCACTGTCAATGTATACATGATTTTA<br>TTGAACCACAAGAAAAGGTTTTTTGGCTTTCTTTTCTTGATGTTGGA<br>ACAGCAGCCTTGATGGGCTTGTTTAATTCAATTGCATATGGGCTAAA<br>TGCTTCAGTACGACGCACTCTTCAACAGAAAATTGATTTGTGGTGGC<br>CAGAATGGTTTAGAAAGTGGCTACCTGGATTTATAATGCTGAGGGAT<br>CAGGCACATGAAAGTGAAATGATCTCACTTAAAATTCCAGTTGAACA<br>GTGATATCGTGTATTGTGTCTAGCTTTTACAGTATTAGGTCTCAACT<br>TATTTTCAAGAAATTACAATCAATCCTTTTGGGAATTCGCTAAGGTT<br>CAGCAGGTGCATCAAGATCAGATGATTCTAATTCATCCTTCACTTGT<br>TGAATTTCATCCATTTGTTTCCAGTCCCCTACGCTGACCTGAATGTA<br>AATGGAAGCCTCTCTATATATTTTAGAGTGTAGACTTTCATCTCTGC<br>AGTGTCCAAGTGTTACAGCTTATTATTTTGAAGTGAGTAACACCTAG<br>ACATGACATTGTACAACTTAAAGAACAATAGAAATTTGCTCTATAAT<br>TGAAGGCAAAAAAAAAA |
| 151 | CGCACGAGGATTTTGTGTGACTTTATTTCTGAACTCTGTGAGGAGTC<br>ACTATTTTCAATGTAAAGAGGTGGAGTCCAAAATCCATTTTAATTT<br>TTCCCATAATAATAGTTTAGCCAGATATCATCTGTCGGATGTATTTT<br>TCCAAAAGCAAGAACTGAACCACTAAATGATTTTTTTTTTCATGAA<br>ACGCTGCTATGAAAATGGTTTCAGTGATCCTTTTAATTTATACTTG<br>GCTTGGTAATGTATTCAGGGTTTCCCCATTATATTTTGTGTTTGTTG<br>GAGGTTTTTCCGGTTCAACATTTAAAAAAAAAAACTGCACACTAATT<br>TAATGAAACCCGATACTTTTTGGTTCTGGAGACGTTCATAATGCACT<br>GTATGCTTTACAATACACAGCCATTCATACCCAGGGATCTCTTTATA<br>TTGATTCACACTCTTATACCTCCATGCCCTCTTACCCATATGGTAGG<br>TTGTTGGGAATAAAAACTTAACGGTCCCATTCTGGCCTCTCACTATC<br>ATACCCAGTGAAAAATATATATCAGAGAGGGCACCCAATAGATAGAT<br>TGAGAGGATCATGGCATACAAAGCAGATGATGACTATGACTACCTGT<br>TCAAAGTGGTGTTGATAGGAGATTCAGGTGTTGGCAAGTCAAATCTG<br>CTGTCCCGATTTACCAGGAACGAGTTCAGCTTGGAGTCCAAGTCGAC<br>TATTGGTGTGGAATTTGCAACTCGCAGCATCATTGTGGATGGGAAAA<br>CGATCAAAGCCCAGATATGGGACACTGCAGGCCAAGAGAGGTACAGA<br>GCCATCACAAGTGCATACTATCGGGGGCTGTGGGTGCTTTATTGGT<br>GTATGATATAACTCGGCACACTACTTTTGAAAGTGTGGAGAGATGGC<br>TGAAGGAGCTTCAGGACCATACAGATAACAACATTGTTGTAATGCTC<br>GTGGGTAATAAAGCTGACCTACGCCATTTGAGGGCTGTTTCCACTGA<br>AGATAGCCAAGCCTTAGCTGAGAGAGAATCTCTCTATTTCATGGAGA<br>CATCGGCTTTGGAATCGACAAATGTTGAGAATGCTTTCACGCAGGTT<br>CTCACTCAAATCTATAGAATTGTTGTCAAGAAGGCTCTTGATGTTAG<br>TGAGGAGCCTTCTGCCCTTCCGCCACAAGGACAAGCAATAAATATCA<br>AGGATGATGTTACAGCTACCAAGAAGCCAATGTGCTGTAATTTCTAG |

TABLE 2-continued

Cell Signaling Gene Sequences

| SEQ ID NO | Sequence |
|---|---|
| | CAGGCAGAGGCAAGTTGTTAGATGATGCGGATATTTGAGCAGATTCT<br>TTACAGTTGTAGTTGTTTGCACGAATTGTTGAGTAACTTCTTTACTC<br>ATTTGAGGGTTTCTCAGTTCTGATGACATATTTGGAGTCACATGAAT<br>GCTCTATTGGCTGAGTTGACAAAATTAATTTCATCGGGTGTCTAGAA<br>TAGAATCAAGGAACATAAATTTGTAACTTATGATGAGTGATTTCAGC<br>GATAAAAAAAAAAAAAAAAAAA |
| 152 | CAAATTTCAAGAAAAGGTTACTGTTTTCGCTTCCCAGGACGGACGGG<br>CGGTCGGTCTGCAACACGCTTTAGAGTTTCAACTGAGATGCTTTCAC<br>ACCCTTAATCCATGAATTGCTTCACTTCCCTTCATTCCGCCATTCGT<br>AGAGGTGCCTCGTTATATCTTGACGTTTTTCATTCAGGTTTTATGAG<br>CTCAAGAAAGGGAAGAACCCATTCATTTTCTCTTGTAAGCAGCGGGC<br>GAAGGCGGGATTGGGGTTTTTGTGTTAAAGGCATGCCGGGCAAGGGT<br>TTTGTTAGGGACACGTACTTGACTGCTGCCTTGCAACACCTCGCATG<br>CGATGACTCAGGGAATTAGAGCTTCTTGGTATTGCACTTGGGCAGAG<br>CAAGGAGCATTCGACTACCTTTGCTGAAACAACTTCGTTGTGAGACA<br>AGCTTTGCAGTGATTGTATTCTATCTGATTTTGGACATGCTATGGCC<br>TCTTGATGCACTGCATTGAATGTTGTTTCATGGGACATTGGGTTTTT<br>ACACATTCTCGTGTAGGAATGCGGAAGCAAGAGTAACTGATTACTAA<br>AATCTCATCAAGATGGAGTCATGTAACTGCATAGATCCGCCATGGTC<br>AGCAGATGATCTGCTAACAAAATATCAATACATATCGGACTTCTTTA<br>TTGCACTTGCATATTTTTCTATTCCACTTGAACTCATCTATTTTGTG<br>AAAAAGTCAGCAGTTTTTCCTTACAGATGGGTGTTAGTTCAATTTGG<br>TGCATTTATTGTGCTTTGTGGAGCAACACACATGATAAACCTCTGGA<br>CTTTTCATGTGCACACAAAAGCAGTTGCAATGGTTATGACTATATCT<br>AAAATATTGACTGCCGTTGTATCCTGTGCAACGGCTCTCATGCTTGT<br>ACATATCATACCAGATTTGTTGAGTGTAAGACCCGAGAACTGTTTTT<br>GAAAAATAAGGCAGCAGAGCTTGATAGGGAAATGGGTATAATACGGA<br>CACAGGAAGAAACTGGAAGGCATGTGAGGATGCTGACTCATGAAATC<br>AGAAGTACCTTGGACAGGCATACAATTTTGAACACCACCCTTGTTGA<br>ACTGGGGAGAACTTTAGCTTTGGAGGAATGTGCTTTGTGGATGCCGA<br>CTCGAACTGGTTTGGAGCTTCAGCTATCCCACACTCTTCGACAGCAA<br>AATCCTATGACTTTTACCGTACCCATTCAACATCCTAGCATCAACCA<br>AGTATTCAGTACAAATCGAGCAGTGATGATTTCTCCAAATAGTCCAG<br>TAGCAATGATTCGACCACGGACAGGCAAGTACATGATTGGAGATGTG<br>GTTGCAGTTCGTGTGCCCCTTCTGCATCTCTCAAACTTCCAGATTAA<br>TGATTGGCCAGAACCCTCAAAGAGATGGTATGCACTTATGGTCCTTA<br>TGCTGCCCTCTGATAGTGCTCGCAGATGGCATGTTCATGAGTTGGAG<br>CTTGTGGAGGTTGTTGCAGATCAGGTAGCGGTGGCTCTCTCACATGC<br>GGCAATTTTGGAAGAATCAATGAGAGCACGAGACCTGCTCATGGAGC<br>AAAATGTTGCACTTGAGATAGCTCGACAGGAGGCAGAAACAGCTATT<br>CGCGCTCGCAATGATTTCTTAGCAGTTATGAACCATGAGATGCGTAC<br>TCCGATGCATGCAATTATTGCTTTGTCATCGCTTCTTCAGGAGACAG<br>AGTTGACTCCTGAACAACGATCCATGGTTGAGACCATCTTAAGGAGT<br>AGTAATCTCCTTGCAACACTCATCAATGATGTTTTAGATCTTTCAAA<br>GCTCGAGGACGGGAGCTTGGAGCTAAACATTCGGATATTTAATCTCC<br>GCAGTATGTTTCGTGAGGTTCACAATTTGGTAAGCCAATTGCATCTG<br>TGAAGAAGTTGTGTGTATCAATGAATCTCGCTTCAGACCTGCCAGAA<br>TACGCTGCCGGTGATGATAAACGTCTTATGCAAACTGTTTTAAATGT<br>GTTAGGGAATGCTGTGAAGTTTTCTAAAGAAGGTAGTGTTTCAGTGA<br>CGGTTTTATTAGAGAGGCCAGAATGCTTGCGAGATCCACGTGCCGAA<br>TTTTACCCAGTGCAGGGTGATCGCCATTTCTATTTGAGAGTGCAGGT<br>AAAGGACACTGGTGCTGGAATCAATCCTCCGGATATTCCAAAGCTTT<br>TTAGCAAATTTGTGCACTCTGACACAATGACAACCAGGAATTATGGT<br>GGCACTGGTCTTGGACTAGCTATTTGTAAGAGGTTTGTGAACCTTAT<br>GGAGGGTCATATTTGGCTTGAGAGCGAGGGATTAGGAAAGGGCTCAA<br>CTTGCATATTTATTGTTAAGCTTGGGATTCCAGATCCTATACATGAA<br>ATGGAGCATCAGTATGTGTTTCCCATTCCATCAAATTCTACCCGTAA<br>AGATTTTCCTGGGCTGAAAGTTCTGGTGACAGATGATAATGGGGTGA<br>ACCGGATGGTTACAAGGAGCCTTCTTGCTCGTTTAGGGTGTGATGTG<br>ACAGTGGTGGATTCTGGTCATGAGTGCTTGCAAGCAATGTCACAGGC<br>TGGGCAGAATTTCAAGGTATTATTTCTTGACGTATGCATGCCGGTA<br>TGGATGGTTATGAAGTGGCCATTCACATTCAGGAGATGTTTCCTAAT<br>CGGCATGAAAGACCATTACTTGTGGCTCTTACCGGAAGTGCTGACAA<br>AGCAACCAAGGAAAAGTGCATAAAGATTGGAATGGATGCGTGTTAT<br>TGAAACCAGTGTCTCTTGAAAAAATGCGTAGTGTACTAGTTGATCTC<br>TTGGAACACGGGTCAGTATGTGACAGTATACAGAGGTTATGACCGTG<br>TCTAAAAAGTGGAAGTTGGTACACGTAATGCTGTGCCATTGATCTTA<br>TGGATCTGACAAACAATGCACTGATTTATTCGTATGAGACCAAAAAT<br>CTCTGCAATCAATTTAACACAACAAAGTTTTGAGATTTACTAGATGC<br>CAAATTTAGTGATTTGCTAGCTCAGTAGTGAGCATATTTGGTCTTCT<br>TCGAGTTGATGTACACTTCCCAGCATCCTTTACATTGGCTAGTTGCT<br>GATAACTGTGGGCTATTCTGCTTTGTCAGCAGTTACAAGAACTGTTC |

TABLE 2-continued

Cell Signaling Gene Sequences

SEQ ID NO | Sequence
---|---
 | AACCTTCTAGCAAATCTGTTGCCCTAAAATATTGCACTGTCTTTGAA
 | GTGCCACGCATGACATATGGAACTGTACAGTATAGTGGCTATATGCG
 | ACCTGAATGA
153 | CGAAATCTTCTCCCCGCCTGTCAAGTAACGGACGTGGGCGTCCATGT
 | AAAGAGCAGAAGAAATGATGGCGATTCGGCTTTGATCAGAGAGGTCC
 | CTATTGCTCAAATTTATCCCGCTGCGCCGACCCAATTCTTTGAAAAT
 | AAAAAATGTCGTTTCGAAAGCGCGCCCTGTTCAAGGTTATTGTTCTC
 | GGTGACAGCGGGGTTGGAAAAACATCTTTGGTGACTCAGTATGTACA
 | TAAGAGATTTAGTAGCCAGTACAAAGCGACTATTGGTGCGGACTTTA
 | TGTCAAAGGAACTTCAGGTTGATGACAGACTTGTAACATTGCAGATA
 | TGGGACACTGCTGGCAGGAGAGATTCCAGAGCCTGGGTGTTGCTTT
 | CTACAGAGGTGCGGACTGCTGTGTACTTGTGTATGATGTAAATGTGC
 | TCAAGTCATTTGACAAACCTGGAAAATTGGCACAAGGAGTTTCTGAA
 | TCAGGCCAGCCCAACAGAACCGGACACTTTTCCATTTATGTTGCTGG
 | GCAACAAAATTGATGTGGATGGGGGAAACAGTAGAGTGGTTTCTGAG
 | CTCAAAGCTAATGACATGGTGTAAATCGAAAGGTATCCCCTATTTTG
 | AAACATCAGCTAAAGATGATTACCGCATTGATGCAGCATTCTTATCC
 | ATAGCCAGATCTGCACTTAAGAATCAACCTGAACAGGAAATCTATTT
 | TTTAGGCCTTCCTGAGGCTCTTCCTGAATCAGAGCCGCCATCACGCA
 | GCTTTTGTGGATGCTAATGTCAGTGCAGGAGTATTGTCTTTTACATT
 | GATAAACAATTTTATAGGCATCTTCTTCTTATTCCCAATGGGAAATT
 | TTTGGGCATTAACGGGTTGGTAGATTGTGTCTCAGTGAATAAGACCA
 | CCAAAATCATGACAGATGATCCAAGGTATCTCGTCATGTCCTTAAGA
 | GCTTGGTTTCTCTTTCTATCCCAGTTTTTGTTCTTGGCCATTCGGTT
 | T
154 | GCGGTACATATATACACAGATACAACTAGATACCCTCTGAAGATTTT
 | TGGGGTAATCTGCGATCATTTTCGTCCGGGAATTTTTTTGTTTGTTT
 | TTAATTTTTGTGGGCTTTGATGCATTTGAAGGTACGTAGGACGTTTT
 | AGTTTTTCCCTGTAGCTCCAAAATCGGCCATGGGGTCTGAAATCTAA
 | GCGCTGTATGCATGAGGCATATTTGTTATTATTAGGATTGCAATTAT
 | TATTATGGTGGTGAGAAGGATGAGCTCGTTCCCTGATGAACTGCTGG
 | AGCACGTATTGGCATTCCTGTCGTCGCACAGGGACAGGAACGCGGTT
 | TCCCTGGTCTGCAAGTCGTGGTTTCGAATCGAGGCGGGCAGCAGGCA
 | GCGGGTTTTCATCGGAAATTGCTACGCGGTGAGCCCCGCTATACTCA
 | TCAGGAGGTTCCCAAGGATAAAGTCCGTTGCGCTCAAGGGGAAGCCC
 | CATTTTGCGGACTTTAACATGGTGCCCCCTGGCTGGGGCGCTGATAT
 | CCATCCCTGGCTGGCCGCCATGGCGGAGGCGTACCCTTGGCTGGAAG
 | AACTCAGGCTTAAGCGCATGGTGATCACTGACGAGAGCCTTCAGCTC
 | CTCGCGCGTTCTTTTCCCAATTTCAAGGTTCTCGTGCTTACCAGTTG
 | CGACGGCTTCAGCACGGATGGGCTCGCTGCCATTGCTGCGCACTGCA
 | GGCATATTACAGAGCTAGATTTGCAGGAGAGTGACATTGATGATCGT
 | GGTGGCAATTGGCTAAGTTGTTTTCCGGACTCATGCACATCGCTTGT
 | TTCCTTAAACTTTGCATGTCTGACTAAGGAGGTGAACTTTGAAGCAC
 | TTGAGAGATTAGTAGCAAGATGTACTTCTCTGAGGAGTTTGAAATTG
 | AATCGTTTGGTGCCATTAGAGCTACTACATCGCCTTTTGGTTCGTGC
 | CCCACATCTGGAGGATTTGGGTACAGGTGCATTCCTTCACGAGCCAC
 | GCACTGAACAATATTCCAAGCTTAAGGTTGCCTTACAGAATTGCAAG
 | CGACTTCAAAGCTTATCTGGTTTTTGGGAGGTTGCACCTGGTTATCT
 | TCCCTTGGTTGAGTCCCTCTGTTCAAATTTGACTAGTCTGAACTTGA
 | GTTATGCAACAATTCAAAGTGCAGAACTTACCAACCTCCTTGGTCAC
 | TGCCACAAACTACAGCGCTTATGGGTGTTGGATTATATTGAAGATAA
 | AGGGCTTGAAGTGGTTGCCTCAACCTGCAAAGATTTGCAGGAACTGC
 | GTGTTTTCCCGTTAGACCCTTATGGTCAAGGAGCCGTGACAGAGGAA
 | GGCCTTGTGACTATTTCAAGGGGCTGTCCTAAGTTGACCTCTGTACT
 | ATATTTTGTTGTCAAATGACAAATGCAGCTTTGATTACTGTTGCAA
 | GAAATAGCCCTCTTCTCACCTGTTTCCGCTTATGTATATTTGATCCC
 | ACAAGCCCAGATCATTTGACAAAGCAACCCCTGGATGAAGGGTTTGG
 | AACAGTTGTTCAGTCTTGCAAAAGTTTACGGCGTTTATCTATGTCTG
 | GCTTGCTTACAGACAAGGTCTTTCAGGTGATTGGTACTTATGGCAAG
 | TGTTTGGAGATGCTTTCTGTTGCTTTTGCTGGTGATAGTGATTTTGG
 | GATGCAATGTGTACTATCAGGCTGTATAAATCTCCGTAAGCTTGAGG
 | TAAGGGACAGCCCATTTGGTGATTTAGCTCTTTTAGCAGGTTCAGAA
 | AAGTATGAATCAATGCGATCCCTTTGGATGTCATCCTGCTCTGTTAC
 | CGTGCATGGTTGCAAGGAATTGGCTGCAAAAAATGCGTAACTTGAAT
 | GTTGAAGTTATCCATGACAGGGATCAGTTTGAAGATATAAGTACCAT
 | GACTCAACCCGTAGATGGACTCTATGTGTACCGGTCAGTTGCTGGAC
 | ATCGGAAGGATACACCACATTTCATATACACTATGTAAGTGGTCATG
 | TCATTTCTCATGTACCATGAATGAAGCTGGCATGTTCTTGCTAAAGC
 | AGCAGAGTACCAAGCATGGATGGGATTTTCCTCTCATACACCATGGA
 | TTATGCCAGAAAATTCTTGTGACTGACACTTTCACCTTCCATCGC
 | AAAATTTGTATGCCTTGTACAGACAAATTTCAGCATTCAAATACTGT TABLE 2-continued Cell Signaling Gene Sequences

| SEQ ID NO | Sequence |
|---|---|
|  | TTGGCATAGAGTTATTACTGTCATTTCAGCACTATGCGGCAGTATCC<br>TCTAATCTAGGACTGTTCGATTGATCGTTGGACTCCCTTAATTATGC<br>TACAGATTATTTAAATGCAGCAAATGAACAGCCTGGCAGATTCCTAG<br>TCTGGAATTAGGCAGTAAATAGTTATTTAATTATATAGGCATACAGT<br>GTGATTTCGTTTCATTTTTTAGAGAACCCTTCCGGTTACCGCTATTT<br>AAGACTGCCATGTTCAGAAAATCTTATTTGATTGAAGAGAAGACAAC<br>ATTCTCTGCACTATTTCTTTCTAAAAAAAAAA |
| 155 | AAATCACATAAAAACAGGGAGATTCGAAAGACGGTTTTCCTGTTGTC<br>GGCACCATTGGAAAATTGAGCCAGGGTTCGAACAAGGGTTTGCAGGT<br>TTCTCATCTCTTTAAGAGCCGTTTGATACAAGACTTCGCCAATTTAA<br>ACAGCAGATCTCTGGAGCTTTCAGGCCCGGAATTGTCCCAGCAACTC<br>GTGCTCTGCGTAATGAAAAATGAGGAACCTTCTCCTAGATCAATGAG<br>GAGAGACGACGCCAGGCCATAATTTGGCAATACATTCGACATAGTTT<br>ACAGTATATTACCAGTTCCATCGATTCCAGAATTTATATTTTGACAA<br>AATCAAGAACTAACTCCCAAAGGCAATTGCATGGTTTGATTCTGGGA<br>TAGTAGTTCTCCAACTCCATCTGGACTGAACACTAAATATAACCACG<br>TCAAAAGTCATGGCACAGCAATCCTTAATATACAGTTTTGTGGCCAG<br>GGGAAACATTGTACTTGCAGAGCATACATCATTTTCGGGGAATTTTA<br>GTATTATTGCTGTCCAGTGCCTGCAAAAGCTGCCCTCAAACAGCAAC<br>AAGTTCACATACACATGTGATAACCACACATTCAATTACCTCGTGGA<br>TGATGGATTTGTGTTTCTTGTTGTTGCAGATGAAGCTGCAGGAAGGC<br>AGGTGCCTTTTATTTTCTTGGAGAGAGTAAAGGAAGATTTTAAGCGG<br>CGTTATGGAGGAAGGGCTGAGACAAGCATGGCGCACAGCCTTGATAA<br>GGACTACGGGCCAATACTGAGAGACCACATGCAATATTGCATGGACC<br>ATCCAGAGGAACTAAGCAAGTTTTTTAAATAAAGGCTCAGGTTTCAG<br>AAGTGAAAGGAATTATGATGGACAATATTGAGAAGGTTCTGGACCGA<br>GGTGAAAAGATCGAACTTCTTGTAGATAAGACAGAAGGCTTGCAATT<br>TCAGGCTGATAATTTCCAGCGCCAAGGAAGACAGCTTCGACGGAAGA<br>TGTGGCTCCAAAATTTAAAATTCAAATTGATTGTGTTGGGTATCGTA<br>CTAGTTATTATGCTTATAATATGGTTGTCCATTTGTAAGGGATTTAG<br>TTGCCATTGACATCTAAGTGGTTTTATGTACATATAAGAAACTGGCA<br>TGTTTATGAGTGGAACAACTTTTTGTATATCATGAAGGTGAATAAGA<br>ATTAAGAACACAACGAGCTAAATGAATTGATAGGGGAGGAAATGCTC<br>ATATTGAGTCACATTTGATGTAAAAAAAAAA |
| 156 | GAGATTCTGAGTCAGGTTCAATACTAAATCATTTCTGTACGAGCGAG<br>TTATGTGTGGTTTGCGGAAAATGACAGAAGATTAGAAAACGAAAGAG<br>CAGATTTCAATGACTGGACGACGAGGAAAAGGAGATAAACAACGTCA<br>CACAAAATGAAAATGTGGAGGGGATGGCATTTTACTGGGTGAGGTCT<br>CCCACAAGGAGAATTGTAGCAGCTCTTCTTCTGGGGGGCGGAATTGG<br>GTGTTTTGTGTGGGGTGCTCACCTCTCCTACCAAAACGTGGCTCCCC<br>AACAGGCTCGCATACAGAAGCGCAACGAGTTCATCCGAAAACGCCTG<br>CAGGCGCGACGATCGGGCAACTAGCCTAACGACCGACTAATGTTTGA<br>TTCCAACTAGCCTACGGTGAATAGAATCGTCGTAATTATCGTCATCA<br>TCAGCAGCAATGTCTATTATAAGCATCCCCGAAGTGGAAGTTGAAAT<br>GGGCTCGGCATCGCCTAACGCCAGGACTCTTCGAGCCACTGTTGTTC<br>AGGCCTCCACTGTCTTCTACGACACCCCTGCTACTCTCGATAAAGCA<br>GAAAGATTGATAGCAGAAGGTGCTGCTTATGGGTCACAGTTGCTTGT<br>GTTTCCTGAAGCTTTTATTGGTGGCTATCCTCGAGGTTCTAATTTTG<br>GTGCTGTAATTGGAAATCGCACTTTTAAGGGTCGGGAGGAGTTTCGT<br>AAATACCATGCTTCTGCTATTGATGTGCCAGGTCCAGAAGTAGAGAG<br>GATATCAGCTGCAGCTGCAAAATATAAAGTGCATGTAATAATGGGTG<br>TGATAGAGCGAGCAGGCTTCACACTGTATTGCACTGTTCTTTTCTTT<br>GATTCTCAAGGAAGATTCCTAGGGAAGCACCGTAAACTGATGCCAAC<br>ATCTTTGGAGCGTGTGATTTGGGGTTTTGGTGATGGATCTACCTTAC<br>CTGTGTATGACACATCAATTGGGCGTGTGGGTGCACTCATATGCTGG<br>GAAACCGAATGCCTCTTTTGAGAACAGCTTTGTATGGAAAAGGAGTG<br>GAACTCTATTGTGCACCAACTGCTGATGCAAGAGAGTCATGGCAGGC<br>ATCAATGCTTCATATAGCTCTGGAGGGTGGATGCTTTGTGCTCTCAG<br>CTAATCAGTTCTGCAGAAGAAAGGACTACCCTCCTCCACCAGACTAT<br>GTCTTTGGAGGTTCAGAGGAGAATATGTCTCCAGAGAGTGTTGTATG<br>TGCGGGTGGAAGTGTTATTATTTCTCCTACTGGTACTGTATTGGCAG<br>GGCCCAATTTTGAAGGGGAGGCTCTAATTACTGCAGATCTTGATTTT<br>GGTGAAATAGTGCGAGCAAAATTTGATTTTGATGTGGTTGGGCACTA<br>TGCAGACCTGAAGTGTTGAAATTGACGGTAAATGACTATCCATTGAA<br>TCCTGTCACATTTTCTTCAGGGATAGCAGCATCAGAAAAAGGACAG<br>TGAGAATGTAAATTTAATCTGCAAGCATGGCCAAGGCCCAGTACA<br>TTCAGATGCTCCCTGAATGGATTTCAGAATTGTCTTAATGGCCAACT<br>ATGCTACCATATGGCATGATGAATAGGCTCGAGCATGAGTAGAAGGA<br>ACTATTTGTTATTGAAAACAGTTGTTTAAGTATCCAAAATGTATAA<br>CTACAGAGACCATCTTTTCTGTAAAACTTATCTTTGTATATAACAAG<br>ATTGAGCATGCCTAGAATAGAAAGAACAATTTGTTATTGAGTAATCA |

TABLE 2-continued

Cell Signaling Gene Sequences

| SEQ ID NO | Sequence |
|---|---|
| | GGGAAACATTTGTATAAGTATTCAAAATGTAGAACTACAGACACCAT<br>AGCTTTGTAATGATTTATATTTGCATATAGCAAAATATAGACATTAT<br>TTTACGGAAAAAAAAAAA |
| 157 | GCGCTCCCGTGGGAAACAAATGCTCAGAGATCCCCACACTGCCCTAC<br>ATTGAGCCGTTCAGCAGCTAAAGTCCCTTACATTTCACTTTAAGCTC<br>TACCCATTTCATTTCTGCGCTTTAACAAGCCCCCTGTGTGCGTTTCT<br>AGTAGCAATGGAGGACGATCCTGGTGAAGATTACTTGTTCAAGGTGG<br>TGTTGATAGGGGATTCTGCAGTGGGGAAGTCGAATCTGCTGTCGAGG<br>TATGCCAGGAATGAGTTTCACATGAATTCCAAGGCCACAATAGGTGT<br>GGAATTCCAGACTCAGAGTATGGAGTTTGATGGGAAGGAGATCAAGG<br>CACAAATATGGGACACTGCAGGCCAGGAAAGGTTCCGGGCTGTCACT<br>TCTGCTTACTATAGGGGAGCTGTTGGTGCCCTCGTTGTTTATGATAT<br>CAGCAGGAGGCACACATTTGAGAGTGTGGGTCGTTGGCTTGATGAGC<br>TCAAAATGCATTCCGACATGAATGTTGTTACAATGTTGGTTGGCAAC<br>AAATGTGATTTGGAGTCTCTGAGAGAGGTACCAGTTGAAGAAGCAAG<br>CCCTTGCTGAAGCAGAGAAGCTGTTTTTCATAGAAACTTCAGCATTA<br>AATGCGACAAATGTGAATGATGCCTTTCAGATTGTAATCAAGGAGGT<br>TTACAATAACATGAGTCGTAAGCCTTAACTCAGGTTCTTACAAATCT<br>AAATTGCTATCAAACGGAAGCACTAGTGTCAACCTTGTGCAGAATGG<br>GGATGCTGCAACAAAGACAGGGTTAAAAAAGTATGGTTGCTGCTGAA<br>ATCAAATCTCTTTTTTCCTCATGGGTTCCAATTTACTTTATTTAATC<br>AAATCTGCAGTGTTAACCACCTGTTATCTACATGGGATTCTTACAAG<br>CTATTCTTCATTTTCAGTTGTAATAAAAATGGAAGCATCTTGGATGT<br>ATTGTGTTGACAGTCAAGCTTGTAGGGTCCTCTGTTTTTGATCTGCA<br>TGTGGAGAGGAATCGGAAGTTTTGTTTGTCTATTTGTGGAGGATCTA<br>TGACATTTGCTGGATCCTAATGCTCCATGTATTCATCAGTGTTTTTA<br>TAGAAGTAATGT |
| 158 | GATCTGCACTCCTCTGTGATTGCTTCTTTTAAGTGTTTTTTGGGTTT<br>GAATTTGCCTTTATACAAAGATGGCAGTGCCCGTTATTGACATAAAG<br>AAGCTGCTGGATGGAGAAGAAAGGGAGATGACCATGGACCAGATACA<br>CAAAGCCTGCCAAGAATGGGGTTTCTTTCAGCTTGTTAACCACGGCA<br>TACCGTACAGTCTTCTTGATAGAGTGAAGGTATTGTTCAAAGAGCAT<br>TACAAGAATTCTATGGACGCGCAGTTTCAGGATTCTGCAGTTGTGCA<br>ATGCTTGGTTCTAACTCCCAAGGCATGAATCTCAGTGCCACTAAAAT<br>AGACGCCGACTGGGAAACGGGCTTCTTCCTCCCACTCTCGTCGCATA<br>AAACAGAAACAGTGACACCGCCTCTGCCTGCCAACTTCAGGGAGACG<br>ATGGAGGAGTTTGCAGAGGAGGTGAAGGGATTGGCGGAAAGATTATT<br>AGAAATAATGTGCGAAAAATCTGGGACTGGAGAAAGTATATCTGAAG<br>GAAGCCCTGGCAGGTGGCAATGGTGATAACAATAGCCCTTTCTTTGG<br>CATAAAAATGTCTCACTATCCACCATGCCCAAGGCCAGACCTTATTG<br>ACGGCCTCCGAAACCACACGGACGCCGGTGGACTTATTCTGTTGCTA<br>CAAGATGATGAAATCGACGGCCTTCAAGTTCTGATGGACGGCACTTG<br>GTTCGACGTACAACCCATTCAACATGCAATTGTTATCGACATAGGCG<br>ATCAGCTGGAGGTGATGACGAATGGGAAATATAAGAGCATGTGGCAT<br>CGTGTGCTTGCTAAAGAGGACGCAACAAGAATGTCAGTAGCAGCGTT<br>TTATAACCCTTCGAGTGATGCAGAGGTGTATCCTGCTTCGCAGCTGA<br>TGTCAGCAGAGCAGAATGGAAGTAACAATGTTAATGCAGAAAGTGGT<br>TATGATTATCCAAAGTTCGTATCCGCAGATTACATGACAGTGTATGC<br>TGCGCAGAAGTTCCTGCCCAAAGAACCGCGATTTGAGGCGATGAGAT<br>CAGTAGGTCATGCCGTGAATTGAGCAGCAATCCACATGGAATTTATA<br>AGGATAATAAAATCAAACTAAAGTAATTAAAAAAAAAA |
| 159 | GTTCTACTTAGCCCTGTGGCTTCTGCCTACAGGATCAAGTATCCATC<br>TTTGTTCTCTTCTGCTTTGGGTATATTTGTTGAGTATCCATCTTGTC<br>AGTTTGTAATTTGGTTTTTAATATTTTTTGACTGGAGGGATTAGGGA<br>TGGCCACCAAGGTGGATCCTCCGAATGGGGTTGCTGCAGAGGGGAAG<br>CACTACTATTCCATGTGGCGCAACACGTTTGAGATAGACACCAAGTA<br>TATTCCCATCAAGCCCATTGGGAAGGGTGCATACGGGATTGTGTGCT<br>CGGCTAAAAACACAGAGACCAACGAGAAAGTGGCTATTAAGAAGATC<br>GGCAACGTATTCGAGAACCGGATCGATGCCATGAGGACACTTCGGGA<br>AATCAAGCTTCTCAGGCAGCTCGCTCATGATAACATAATTACCTTGA<br>AGGACATCATGACCCCTGTTGGCAGGTCTAATTTCAGGGATGTTTAT<br>CTGGTTTATGATCTCATGGATACTGACCTTCACCAGATCATCAAGTC<br>TTCTCAGGCCCTCACTGATGATCACTACCAGTACTTCATCTACCAGT<br>TGCTGCGAGGCCTAAAATATTTGCATTCTGCCAACGTGTTGCATAGA<br>GATTTGAAGCCAAGTAATCTATTATTGACTGCCAATTGTGACCTTAA<br>GATATGTGATTTTGGTTTAGCTCGAACAAACTGTGAGACAGGGCAGT<br>TCATGACTGAATATGTTGTCACTCGATGGTATAGGGCTCCTGAATTG<br>CTTCGTCCTGTGATGAGTATGGTCCATCTATTGATGTGTGGTCTGT<br>AGGCTGTATTTTGGCAGAGTTGTTGGGCCGACAGCCAATATTCCCTG<br>GTAAGGATTATATCAATCAACTTAAACTGATCATCAATGTTATTGGC |

TABLE 2-continued

Cell Signaling Gene Sequences

| SEQ ID NO | Sequence |
|---|---|
|  | AGCCCAGCGGAAGATGATCTTTACTTTGTCCAGAGCCAGAAGGCCTG CAGCTACATCAAATCACTTCCTCATGTTCCCTCTGCTTCTCTGCAAC GTTTATATCCTCAGGCAAATCCTACTGCCATCGACCTACTAGATAAG ATGCTAGTTTTTGATCCTTACAAGAGGATCACTGTTACAGAGGCTCT TGAGCATCCATACTTCTCTGCGTTACATGATCCAAGGCTCGAGCCTT CTGCAACAGCACCTTTTGAATTGGACATGCCTGATGAGGAATTGAGA GTACAGGAATTGAGGGAGATGGTCTGGAAAGAAATGCTATATTATCA TCCAGAAGCTGCAAATATATTATAGATACACAAAATTATCCATTTGT TTTTTGTTGGATAACTTCATGGATGAGAAGATGAGATGTAGAGATGG ATAAAGTTTGAATATATCTCAAAGCACGGCCTTGAGTTTTGTTCAAA AAAAAAA |
| 160 | GAAAAGACATTCCCGTGTATTGAATTGGGAAGCAATGGGAATCGAAC TAGAGATGGACAGACCCCAGGAAGAGGGCTGGGTGAGGGGTGCCATT CTTGGGGCCGGAGCTTACGGAACAGTCAGCCTTGGCGTGAGCAGGTC CAATGGCCAACTCTTTGCAATCAAATCTGCAGCCGGCTTTAGTGTCG CTTTGGAAAATGAGTACCAGATTTTGCGGTGCCTCGATTGTCCATAC ATCGTTCGCTGCCTGGGGCACAATTACAGCTTCGAAAACGGTGCAGA GGTGCACAATTTATTCTTAGAGTACATGCCAGGTGGCAGCTTGGTGG ATCTACTGGGAAGGTTTGGAGGGACGCTGAACGAAACAGTGATCAGA GCATACACACGCGGCATCCTGCGTGGACTCGATTACCTACACAGTCA GGGGATTGTGCACTGTGATATCAAGGGGAAGAACATTCTTGTGGATT CCAATGGTGTGAAGCTTGCTGACTTTGGTTCTGCTAAGAGGGTTGAT GATGAGGAGAAGTGCGAGGAGGCCATGCAATTGAGGGGAACCCCTCA GTGGATGGCTCCAGAGGTGGTGAATCAGGTGGAGCAGGGGCCTGCTT CTGATATTTGGTCTCTCGCCTGCACTGTGCTTGAAATGGCCACTGGC AGGCCTCCATGGAGCCACGTTTCCAGTCCCCTTGCCGCAATGTATCG AATTGGATGCACAGAGGAGCTGCCTGGGTTGCCTGGATGTCTTTCAC CTCAGATTCGGGATTTCCTAGAGAAATGCTTTCGGAGAGATCCTAAG AAGAGGTGGAGCAGTGCAGAGCTGTTGAACCATCCTTTCTTAAAAAA GGACTGCTCTGTTATTGAGGCAGAGGAGGCCATTAGGGGTCCGGGAT CTCCCACTAGTCATTTGGATTTTAGGAATCACATATGGGATTCCTAC TGTTCTCAGACGACTCTCATTCCGTCACTCAGTCTCCCAAGCCCAAC TAGGGAACGCAATGCAGAGGTGAATAGATCAGTTGAGCAATGCCCAA GGCGTTCTCCCAGAGACAGATTGATGGCACTGGCCGCAGCTTGTAAA TTTGAAAAAGTTGCGAACAGGCCTAATTGGATCACAAGCCTCCATGG TCCATGGACTGTTGTGAAATCTTCCAGAAGTAAATCTCCAACTTCAG ATAAGCCTCTGTTAAAATCAGACATTAGTAATGGCTCCTCCATCCAG GAGCTTCCATTTACGGAAGAAAGGTGCAGTACCAGCTTCAAAGCTGT CAATTGGAAAGGGTTGCAGCCAAGAGGTGAACTAGATCAATGCTCAC AGGCTATGCTCTCTTCAGCCCAATCTCAACATCAACCATCTTCCAGC ACTTCTTCCAAGACTCCGCATCATAACTTGTTTTCGCTGGCTGAGAC ATCCAATTTGACTGGTGAAGCTTGGGAATCGGATGGAAATTCATCTC AGAGGATTGTTGGTGGTGATTAGTAGTTGAAGAAACGCTTTATATGT TTGATGATAAGCGTAAGTCTACGACTTGTGCAGGAGCAACTTACTGC CCCTGTCGCTGTATGCGAACTCCACAATTTTGTCATACAAGTATCAG AAATCTGTAGTTGTATAGTAGCCGCAGAGCAGATACATGCTCTTGTA ATTTTGATTCAAAATTAATACCGGTTGAGTTTGTTCGGTTACACTAG CCGCAGAGCAGATACATGCTCTTGTAATTTTGATTCAAAATTAATAC CGGTTGAGTTTGTTCGGTTACACAATATATGACTTCATGATTAGCCA TTTAACTTAAAAAAAAAAA |
| 161 | GTCGCTGCTCCTCCCGCTACGGAAATTTCTTCCCTATTTGAACCCCT TTCGAGCCACTGGTTTTCCAAGGACCATACTGCGCCTTCTGCTGCTT CGCTTCTTGTGATTTTGCATTTCAGACTCTAATCAAGTTTGTATCCA TTGAACAACAACAAAAATGTCGGGTCGCAGAAATCCGCTGTTGAATA TCCCAATTCCTGCTCGGCAACAGACTCAGCTGTATCGACTTCCTCTG CCTCCGCAGAGCACATCTGTGTCCAGAGACGTTTCGGATCTTGCAGA CTTGGAGCGAATTCAGATTCTCGGCCATGGAAGCGAGGGCAATGTGT ACAAGGTCCGACACAGGAGGACTTCGGAACTTTATGCCCTGAAGGTC ATCCATGGCAATCACGACGAGACTGTGAGGCAGCAGATAATCCGACA AATGGAGATTCTGAAGAAAACAGAGTCCCCGTATGTGGTGAAATGTC ACGGGATTTTCGAAAAGGGGGGAAGAGATCCACTTCGTGCTGGAGTA CATGGACGGAGGGTCGCTGGAACAGAGGAGATCCGACACCATGTCGG AAAGATTTCTGGCAGAGGTAGCAAGGCAGGTCTTGGAGGGTTTGAAA TATCTGCACCGTCACAAGATCGTGCACAGAGACATAAAGCCCTCAAA TCTGCTCATAAACAGGAGACAAGAAGTGAAAATTGCAGACTTTGGGG TTAGCAGAATTCTGTCTCAGACATTGGATCCCTGTAATACTTATGTG GGTACCTGTGCCTACATGAGCCCCGAGAGATTCGACCCCGAGACCTA CGGCGGACGGTACGATGGATACGCGGGCGATATATGGAGCTTGGGGT TGAGTCTGCTGGAGTGCTATACTGGGCATTTCCCGTTTCTGGCAGCA GGGCAGAAGGCGGACTGGCCGGCCCTGATGTGCGCAATCTGTTACGG GGATCCCCCGGCTCCTCCTCCCACGGCATCTGCCCATTTCCGGAGCT |

TABLE 2-continued

Cell Signaling Gene Sequences

| SEQ ID NO | Sequence |
|---|---|
| | TCATCACATGCTGCCTGCACAAAGATGCCCGCAACAGATGGACCGCT |
| | GCTCAGCTCTTGGGGCACCCTTTTGTGCTGTCAAATCCCCCCCAGAC |
| | ACCCTCCATTCCTATGCAGAGGCTCTCCATCTGATCCAATGTTCCCC |
| | ATGCGCAATTACTCTGAACACATGAGATGAAATAAAACTGCATGTGT |
| | ATGAATCTATGATCTGTCTAATAACTTGGGTAAATTTTGTTCAAATA |
| | CCTGGTTTTGGTTTTCGTTTTGTTTAAAAAAAAAA |
| 162 | CATTCATCCATCATGCATTCTGCCTATCCATCTTCCCCGAAACCGTT |
| | GCATCCCTGCCTCTTCATTTCATAGTCTCCTTCCATGCACATCTTAA |
| | CTAACACATACACATTGTATATACATCTTTTCCGTAGTACCCACTTC |
| | TCTGCCCTGCTGCTGCTGCTACTGCAACATCCTCCCGTGCACAGCCC |
| | TTATACGACACACACACATCGAGTAACCAGACCCTCGGCTCCCGTTT |
| | TAGGCATATGCACGTCGAGTATCGATCCATCTGCTCAGTCTGCAGTT |
| | TGAAATTTTCGATTATTTGTTTCTGATTCGGAAGGATGGCCACCAGG |
| | GTGAATCCGCCTAACGGAGTGTTTGTGGAGGGGAAACACTACTATTC |
| | GATGTGGCGCAACATATTCGAGTTAGACGCCAAGTATATTCCCATCA |
| | AACCTATTGGGAAGGGCGCCTATGGAATTGTTTGCTCGGCCAGAACG |
| | CAGAGACCAACGAGAAAATTGCCATTAAGAAGATCATCAATGCATTC |
| | GAGAACCAGACCGATGCGAGGAGGACGCTCAGGGAAATCAAGCTTCT |
| | CAGGCTGTTCGCCCATGATAATATAATTGCCTTGAAGGATATCATGA |
| | CCCCTGTTACTAGAACTAATTTCAATGATGTTTATCTGGTCTATGAT |
| | CTTATGGACACTGACCTACACCAGATCATCAAGTCTTCTCAGGTCCT |
| | CACTGATGATCATTGCCAGTACTTCATCTATCAGTTGCTGCGAGGAC |
| | TAAAGTATCTGCATTCTGCCAATGTGTTGCATAGAGATTTGAAGCCA |
| | AGTAATCTATTATTGAATGCCAATTGTGACCTTAAGATATGTGATTT |
| | TGGCTTAGCTCGAACAAACTGTGAGAAAGGACAGTTCATGACTGAAT |
| | ATGTTGTCACACGATGGTACAGGGCTCCTGAATTGCTTCTGTCCTGT |
| | GAGGAATATGGTACATCTATTGATATTTGGTCTGTAGGCTGTATATT |
| | TGCAGAGTTATTGGGACGAAAGCCCATATTCCCTGGTAAGGATTATA |
| | TCAAACCAACTTAAACTGATTGTCAATGTACTTGGCAGCCCAGATGA |
| | AGATGATCTAGAATTTATCGAGAGCCAGAAGGCCCGCTCCTACATAA |
| | AATCACTTCCTGTTACTTCCCATGCTTCTGTACAACGTTTATACCCT |
| | CGAGCAAATCCTTCTGCCATCAGCCTACTAGACAAGATGCTAGCTTT |
| | TGATCCTCGCAAAAGAATCACTGTTACAGAAGCTCTTGAGCACCCTT |
| | ACTTTTCTGCACTTCATGATCCAAGCCTAGAGCGTTCTGCAACAGCT |
| | CCCTTTGATTTGGACATGCCGGAGGAAGAACTGAAAGAGGAAGAATT |
| | GAAGGAGATGTTCTGGAACGAAATGCTACATTATCATCCGGAAGCTG |
| | CAAATACATCATAGATAGGTGTAAAAATGTCTATTGTCTTGTGTTGG |
| | ATGACTTCATGGAGGAGAAGATGAGACAGAAAGATGGCCTGGCTGAT |
| | GGGACAGAAAGATGGCCTGGCTTTGAATTATATCTTGAAGTGTGGCG |
| | AGAAGTTTTGTTCAATATTGTACATGTATACAATTTCAATTTGTGCT |
| | TTCTCTCTGGAATTTTTCTGAGAATTGCGGACTTTTATTTTCAATGC |
| | TCTGAAAGTATGAAGAGAGAGCGAGTCTTTTATAACAGGTTATTTTA |
| | TTGTAAGAAAGCACACTTGTTTATGTGTAATTTATTCATCATATTCC |
| | CATTGTAAATAAGATGGACTGCTAGTTGTCTAAATCAATAATATACT |
| | CTTTGATAAAAAAAAAAAAAAAAAAAAAAAA |
| 163 | GCTCCAGAATCCACTAGTCTTTTCCACATGCACGGTCCAGTCCTCAG |
| | TGTTCACCCATAAGGACACCCCATGTTGTTAATGTATCCAGCAGAC |
| | TATCTGCCTTATCTTGCCTTGCCGAGCCTGCTGTAAAGCCACTATCC |
| | CAGACCATGACCATGTTTTCTTTATTGTTTTCTTGTCTGCTAGCTCG |
| | CCCATAAGACCTGCCTGTCCCCTTCCGAGCACTGCATGTTTTTTGTC |
| | TCATCCCCTGTATCATGAACCACAATCTTTTAGAATATACAACTCTC |
| | GCTCTGCTCTTTCTCAGCGCCTGCAACACCCACCTTGATTTCTGCAA |
| | TCTCCTCTGCTGCATTTCTTCTTATCTTCTGAACTTCATTGAAGGCC |
| | TACTACACTTCTACATATGAATGGCTTCATGTCTTTGCTCCCCTCTC |
| | TCAACTGCATGAACTGTTGTTATTCTTGGGAGGATTGAGGAGATCTA |
| | GGTTCTTCTTGACCATACTACTCAGCTTTGTTGAAATGTACTCGAGA |
| | ACTTCATAATGGACTCCACCATGCCCGGTCTTGTCCCCACCCGTCGA |
| | GTAGGTACTGCTTATTGAGTATGCTATCAGATTCGGCCCCAGAATCT |
| | CATCTCCACGCTTTCCAAGGCTTCAGAAAGCTATAACTGATGTGGGT |
| | GTGGTGAAATCTCATCCCCATACTTTTAAAGGCCGTTCACAGAGCTC |
| | GGGACTGATGTGGGTGTGGCGAAATCTCATTTCCATACTTTTAAAG |
| | GCCTGTCACAGAGCTTGGGACTGATGTGGGTCTGGTGAAATCTCGTT |
| | TTCATACCATCACTGAGCTGGAAACTGACACGGTTATGGTGATAGAA |
| | GCCATCCATGGTGCTAAAAGTCAATACTAAGGAGACCCACCAGCGAA |
| | AACAATGCTGGTAGTTCTTGCAAATGGTTGTTGGCTTTAGCTTTTCA |
| | GTCATTCGATGACTACAGACGATGAGAAGGGTGCCCAGATGGCCCAA |
| | ATGAGACAGGAACATTCAGAAAACCCTGAGGAGGAGGAGGAGCGTGT |
| | GAGCTTTGATCTGAACTCCATGTGCAAGTTTTCATCCCAGAGTGACA |
| | CAGAACCCATTGAAACCTCCTTCCCCGATGAAGTTCTCGAGCATGTG |
| | CTTGTGTTTCTGACAGCCCACAAGGACAGAAATGCAGTTTCTCTGGT |
| | CTGCAAATCGTGGTACAGAGTAGAGGCTTGGACTCGACACCAGGTCT |

TABLE 2-continued

Cell Signaling Gene Sequences

| SEQ ID NO | Sequence |
|---|---|
| | TTATAGGGAACTGTTATGCTCTTTCGCCTGGGACTATGATTAACAGG<br>TTCCCCAAGATAAAGTCCGTGACATTGAAGGGTAAACCTAGATTTGC<br>GGATTTCAATCTGGTGCCTCCGAACTGGGGAGCCCATCTGCATCCAT<br>GGGTTTTGGCCATGGCTCCGGCCTATCCATGGCTGGAGAAGCTGTTA<br>TTGAAGAGGATGACTGTTACAGACGAAGATCTGGCTCTGCTTGCCGA<br>CTCTTTCCCAAACTTTAAGGACTTAGTACTGCTTTACTGTGATGGAT<br>TCAGCACCAAGGGCCTTGGTATAATTGCAAGCAAGTGCAGACAATTA<br>AGACGACTTGATCTGAATGAAGATGATATTGTCGATAGTGGAGTTGA<br>TTGGTTGAGCTGCTTTCCAGAAACAACTACCACTTTAGAATGCCTTA<br>GTTTTGAATGTTTGGAGGGCCCGATAAATATTGATGCACTTGAAGAT<br>TGGTGGCACGTTGCTTGTCTCTAAAAGAACTAAGGCTGAATAGGACT<br>ATCTCTATAGTGCAGCTGCATCGACTTATGTTGAGAGCCCCACAACT<br>TACACATTTAGGAACAGGCTGTTTCTCCTATGATTTTATACCGGAGC<br>AAGCAACAGTTCTTCAGGTTGCCTTCAACAATTGCAAGTCACTTCAG<br>TGTTTGTCAGGATTTCGGGAAGTTGTTCCTGAGTATCTACCAACAAT<br>CTATTCTGTTTGCAATAACTTACTGGAGCTGAACTTGAGTTATGCTG<br>TTATGGGTAGCAGGGAGTTGGAGCAGATTGTCTGCAATTGTCCAAAA<br>TTGCAGCGTCTTTGGGTTTTAGACTCAGTGGAAGATGCAGGTCTACG<br>GGCTGCTGCTGCAACCTGTAAGGACTTGAGGGATCTCCGAGTTTTCC<br>CCATGGATGCAAGAGAGGATGGGAATGGTTGTGTATCTGATGAGGGT<br>CTGGTTGCCATTTCAGAAGGATGTCCAAATCTCCAGTCGATACTTTA<br>CTTTTGTCAGCGTATGACAAATGCAGCAGTTGTGACCATGTCAAAAA<br>ACTGTCAGAACCTTACCAGCTTTCGACTCTGTATCATGGGTCGGCAC<br>AAACCTGATCATATTACTCATAAACCAATGGATGAAGGATTTGGTGC<br>CATTGTAATGAACTGCAAAAAACTGACGAGGTTGGCAGTGTCTGGCC<br>TTCTGACCAATAAAGCATTTGAATACATTGGGACATATGGAGAATCA<br>TTAGAGACCTTATCAGTGGCATTTGCTGGGGAGAATGATTTAGGCAT<br>GAAGTATGTTCTTGATGGATGCAGACGTCTACGGAAGCTTGAAATAA<br>GGGACAGCCCTTTTGGAGATACTGCCCTTTTGTCTGGTTTACATCAT<br>TATGAGCAAATGCGATTTTTATGGATGTCTGATTGCAAGGTCAGTAT<br>ACAGGGTTGCATGGAGCTAGCAAGAAAAATGCCCTGGCTGAATGTGG<br>AAATAATCAGAGAAATAGCTACGATGACCGCCTTGTGGAAAAACTTT<br>ATGTATATCGTTCTGTAGCAGGGCCTCGTAAAGACATGCCACCAATC<br>GTAATTACTCTGTAGCCATTTCCTGTCCAATTTTGTGGCAATGGCCA<br>TTGTACTATTTGGGTGAATCTGTAAGCGACCGTGCTTTCAGTTCTTC<br>ATGTCCAGTGGTTGTAGGGGTCAAGTCCTTGTACATATTTCTTTTAC<br>AAGTGCAGTGGAGTAGGAGGTCAAATTGGCAATATTCTTTGGCATTT<br>CCTTCAGGGTGATGCTGAAAGGTGGAGGACGACCAATGAATGCTCTA<br>TGCACACGCATTGGGCACTATTTTAGGGTCCCCAACTGACATGATTT<br>TAAATTGAAGTTATTGTTAAGTAATGACTCTTTTAATGAGTCTTTTT<br>GCCATGTCACTTCAATAAGCTTTTGAAGTGAATTCTACATGGATAAT<br>TTTAGTTGTTTTTATTAAGAAGGTTTGACTTACACTTACTAAAAAAA<br>AAA |
| 164 | CCAATAGCACCATCTGAAAATGCTCGGACACAGTAAATTAATTCACT<br>CGAGAATAAGTTCCTCGCCATTCACAATAAATGCGCAGAGCATTGCC<br>ATCCATGCTCTTCATCTACTTCCGTCCTGGCTATCCTATCATGCCAA<br>ATTTGCAGATAGGTTTTAGGGTACCTCCAAATGGGTTCAAGCAGTCA<br>TCGGGAAATGGAGCAGTGAAAGGCGGTCAGCTGTTCCAAAGAGGAT<br>AAAATTAGAGCAAAGCAGAGTGAATTTGATGAGAAGTATTGTTGAAGC<br>TAAGGACTCATCTGCAAAGGCTACAGATGATGCTACTCTCAGACGTT<br>TTCTGCGTGCACGAGATTTGAATGTGGGAAAAGCTTCTGAGCTTTTC<br>TTGAAATATCTAAAGTGGAAGCGAGCATTTGTGCCCCTTGGCTATAT<br>TCCGAGTCAGAGGTCTCCAATGAACTCAGGAAGAATAAGATTTTTA<br>TTCAAGGACTGGACAAACAAAGGCGCCCCATTGGAGTGATTCTCGCT<br>GCAAGGCATAATGCCTTTGACAGGGATCTAGAGGAGTTCAAACGGCT<br>AGTTGTCTATGGTTTTGACAAATATGTGCCTGTATGCCAAGAGGACA<br>GGAAAAGTTCGTCATGTTAGCAGATCTCGAGGGTTGGGGGTATAAGA<br>ATGTAGATATCCGTGCCTACCTTATGGTACTTGAAATTATGCAGGAT<br>TGTTATCCGGAGCGGCTGGGAAAGTTATTTATGATTCACGTCCCATA<br>CCTATTCTGGGCAGCATGGAAGACGGTTTATCCGTTCATTGACAAAG<br>TGACCAAGAAAAGATTGTTTTTGTTGAAGATAAACACCTTAAAGAA<br>ACATTATTGAATGATATTGATGAAAGTCAACTTCCAGAAATTTTTGG<br>AGGGAAATTGCCTTTAGTACCTACTCAAGATTGTGTCATACCCAACT<br>AACACTAGATACCTTGAGTTAGGAATGTGGAAGGTTTAATAGCAATG<br>GTTACCAAAAAGTAGATTAGCTTTTCTTTAGACATATATTGCAAATC<br>CTATTATCTTTCCATTTTTTTTACCTTTTTCATATGTATAATATTG<br>GTTTTGAAAACATTGAGAATGGTCAATGTTTTGACATTTATAACAAA<br>TTTATTAATAATTTAAAAAAAAAA |
| 165 | CAGGGGTTGAAAATTATCTCGGTAAAAATTAGGGTTTTGTTTGATGA<br>GAGGGCGCGAGAGGCCAGTTGATTAGATTGCCCCATCAGATTCCCAC<br>GTCCGACTCTCTGGCCGATGACAGAGCTTCCATTTAATAATTCTGCT |

TABLE 2-continued

Cell Signaling Gene Sequences

| SEQ ID NO | Sequence |
|---|---|
| | CATTACCGTGTCGCTATTGAAGTAAGAGAACCCAAAGGCTCTGACGA
TGCTCTTGATTCCCTCTGTGGACGCGCTTTAGATTTGTTCATTTCTT
CTAAAATGGAGAACGTTGGCGGTGAGGAGTACCTGTTCAAGATCGTG
GTTATCGGGGACTCTGCGGTGGGTAAATCGAATTTGCTGTCAAGGTA
TGCTCGCAACGAATTCAACGCCAATTCCAAGGCAACGATAGGCGTAG
AATTCCAGACCCAGGTGATGGATATCGATGGGAAGGAGGTCAAGGCT
CAAATCTGGGACACAGCAGGCCAGGAGAGGTTCCGGGCGGTCACATC
GGCATACTACAGGGGAGCTGTGGGAGCCCTCATTGTGTATGATATCA
GTCGCAGGCTTACTTTTGATAATGTCGCCCGCTGGCTCGAAGAGCTC
AAGATGCATGCTGATGGCAATGTCGTGAATGCTTGTGGGAATAAGT
CTGATTTAGCTCATATCAGGGAAGTTCCTGTGGAAGATGGGAAGAAG
CTTGCCGAATCAGAGGGGCTGTTCTTCATTGAGACCTCGGCTCTGGA
TAATACAAAATGTATTGCCTGCATTCCAAATTGTGGTCAAGGAGATT
TACACTAATGTGAGCAAGAAATGCTGAATTCGGATTCCTATAAGTCT
CAATTGTCTCTCAACAGAGTTAATATTACGGATGCATATGGAGATGG
AGATGGAGTGGATCCACCCAAGACAAAGAATTCTTGCTGCTGAGGAT
TCAGAGAGAATGCTCCTTTGTTTCTGGGCTCCTTGAATATTATTTGC
TTCATATGACCTCTTGTTGATTGAGATCCTTAAGGCTGCCTTATGCT
AATTTAATTTTTTTTGTTTATTAGGAAGTTTCAATATGTTGGATAA
TTTTTTTTCAATTTTATGAAGAAACCAGTAAGGGTCCCCAACTGGGC
TTCTTAGGCTTGAGCCCTAGATGCT |
| 166 | GATTGGAATTCATGAGACGAAATTACGGTACAGATGAATGGCTGGAA
ATAATGAATCCCAATAAAATGAGACCTTGAGATTCACCCAAGAGAGT
ATGGCCTTTCCTGGTCTGGTTTTGGTAAGGGCAGAGTCGTATAAAGA
AGGCGGAAGGGAGGAGGGCAGAGTCGTATAAAGAAGGCGGAAGGAAG
GAGGGCAAGTGAGAATTCCCTAGCAAAATCGCGTGGACAAATGGTCA
ATTCGTATATGTGGAATGCACCCAGCCAGGAATTTCGTTGCGGGCAG
AGGGCAAAGACAAGGGTTATGGCTTTTTTCGAAATTCATTCGGTTCA
AATTTGACCTGAATACGGTTTCTAACAGGTTAGAATATACGATTCTA
GACGCTTTTACTTGGTCGCTGCACGCAGTCCTAATTGTTGTTTTCCT
GTTCTTGTGGTTTTCCAACATTTTTAGGATCATATACCGGAGTACCC
TTACATGAATTTTAGCTCCAGAGGTTCGGATTTGGGTTGATGCCGCG
AGGCTTGTGATCTGTGATACATTGTCGTCGTTTGACCCAAGAATCGA
CCCAAATCCATTCTTTATATGTAATATGCAGGAAAGGTCCGAGGAGT
AAGGATTCCCAGCCTAGAACCCAAAAAATAAGGTCCAAGGTCGAAGT
CAGAGGCTTGTGCTACATCCCAGTGTTTTTGGGATTCTGTCGAGTC
CTCAAGAGGGCTTTTTGCTTTACGGAGTACCCATCTGGAATTAGTGA
GTTCAGTTGCCTGCCTAAGAGTTCCCGCATAGGGCAAGGATTTGTTT
GAGATTGAAAAAGGAGGGCTTTTGCAATGGGGCATGCGGCATCTGTG
GTCATTCCCCCACAAGAAACAAAACAAGAGGATGAGGATTCCCAAGA
AGGCGTAGACTACACCCTGAACATTCTGATGAATGTCTGGCACACG
TTTTCCATTACCTGAAGCCTGGTGATAGGAAGCCCTGCTCTTTGTG
TGTAAGAGGTGGCATCACGCGGAAGGGCAGAGTCGGCGTCGGCTGTC
TCTTGATGCACGGGCGGAGATTGTGCCGGCCATTCCTAGTTTGTTTT
GGCGCTTTAATTATGTTTCCAGGCTCGCACTCCGAGGCAATCGGAGG
ACGATTGGTATCAACGATGACGGACTGCTTCTGATCGGCATTCATTG
CAAGAACTTGAAAATCTCAAATTGAGATCCTGCAGAGAGATAACGGA
CATTGGAATGAGTAGGTTCGCACAGTTGTGTGGTTCCTTGAGGAAGT
TTTCTTGTGGGTCATGTACATTTGGTACTCCGGGGATCAATGCTATC
ACGACCCATTGCAAATCTTTGGAAGAGCTCACTGTAAAACGGTTGCG
AAGCGCAGGGGAGGTCCCTTCTGAACCAGTTGGACCTGGAGCGGGGA
ATCTGAAGAGGATTTGTTTGAAGGAATTATACTACGGACAGTTCTTT
GTCCCACTGATTGCAGGGTCAAAAAAATTACAAACTCTTAAGCTTTC
TAAATGTTCTGGGGACTGGGATACTCTTTTGGATATCATCACTCAGG
ATGTCACAAGCCTTGTTGAGGTTCTTTTGGAAAGATTGCATGTGAGC
GACACGGGTTTGCTAGCAGTTTCAAAATTGGCAAGCCTGGAAATTTT
GCATTTGGCTAAGACGCCAGAATGCTCTAATACTGGGCTTGCAGCTA
TTGCAAATGGTTGTAGAAAACTGCGAAAATTGCATGTAGACGGATGG
AGAACAAATAGGATTGGTGATGAGGGTCTTATTGAGATAGCTAGAAA
GTGTCATTATCTGAAGGAGTTAGTATTGATTGGAGTCAATCCCACTA
TAACAAGCTTAAGTATGTTGGCTTCCAATTGCCATGTATTGGAGAGA
TTGGCTCTCTGTGGCAGTGCGACTATTGGTGATGCGGAGCTTTCTTG
TATAGCAGCCAAGTGTTATTCACTAAAGAAGCTGTGCATTAAGGGCT
GCCCAGTCTCTGATCAAGGCATGGAATCTTTAATAAGTGGATGCCCC
ATGCTCGTGAAGGTGAAAGTAAAGAGATGCAGAGGTGTAACCAGTGA
GGGTGCGGACTTGTTGAGAGCTAATAAAGGTTCCCTGGATGTAAGTT
TGGATACTATAACCTCACCTAGTCTGAATGGGTTATCAACTCAAGCC
AGCTCGAGTGTGCCAAGAGCATCTGCCATTTCTTCAGCTGGTAAATC
AACTCTATCTAAGGCAAGATTGACCCTTATAGCAGGTGGAAGCTTTC
TTGCCTGTGCCTTTTTAAAGTTGTCAAATGGCTCATAAGTGAACCTC
TAAGGCTCATTATGCGGAGGTCTAATTGACCAGTATTGTTGAATAAA
GAATACTGCATTTGCTGTTTATCTTATCAAACCATTTACTGATGGAT |

TABLE 2-continued

Cell Signaling Gene Sequences

| SEQ ID NO | Sequence |
|---|---|
| | ATCTGAGGTATTGATGTTGTACGATCCTCAGATCTACCTTTGATGCG<br>TTATGCTGATTATTCATTTGGTACATTCTGAGATTGCGCATGGGTTT<br>CTGAATTGGCAGAAGCAAACTGGGTTGAATCAATACAGCTAATTTTC<br>TTTTTTTGAAATTAATGTTTTTTGGGATTGGATTTGACCAAAAAAAA<br>AA |
| 167 | TGGCTATGCAGCGCTCCAGCGGAGCCTGCTTTGATGCAGCCATTCCT<br>TCAACAGCTCTGTTCTTTGGTTGTTCAGAAATTCCTTGATGAAGTCT<br>GCTCCGTTCCAACCTCATGGTTTGGCAGTGGTCCAAATTATTTACAG<br>GTTGTTGGGTTCGGTTTTAGCCCGACTTACTTGGTGGGGGCGACGCA<br>TCTACAGCGACGGACTTCACCGGTTACGGTCTTGAAGGATTCAAGAA<br>ATTCGAGTTGCATGAAAGAATGGCCGGCTTAGATAATGGGGTAGTTA<br>ATGGTATCGTGTCTGTGAAATTCACCAAACTCTTTATTGATGGAAAA<br>TTTGTGGACGCAATTTCAGGGAAGACTTTTGAAACTTTGGATCCTCG<br>AACAGGAGATTTGATAACGCGCGTCGCAGAAGGTGATAAGGAGGATG<br>TGGATTTGGCTGTGAAGACGGCCCGGGAGGCTTTCGATAAGGGACCT<br>TGGCCTCGAATGTCTGGCTATGAAAGGGGTCGCTTACTGAATAGGTA<br>CGCTGATTTGGTAGAGCAGTATATAGATGAACTAGCAGCTCTTGAAA<br>CACTAGATAATGGACAACCACTCACCCTTGTCCGTGTCATTGTGACG<br>GGGTGTATCCAGATTCTCAGATACTATGCAGGAGCGGCTGATAAAAT<br>ACATGGGGAAACATTAAAAATGGGAGGGCAATATCAGGCATATACTT<br>TGCATGAGCCTATTGGAGTGGTCGGTCAGATTATACCATGGAACTTC<br>CCACTTTTCATGTTTTTCATGAAAATCTCTCCAGCTTTGGCTTGTGG<br>ATGCACTATAGTTATCAAACCTGCAGAACAAACTCCTCTAACTGCAC<br>TTTATTGTGCACATCTGGCCAAGGAGGCAGGGCTTCCACCTGGTGTT<br>CTTAATGTGATAACTGGTTTTGGAGAAACGGCTGGTGCTGCAATAAG<br>CAACCATATGGATATTGACAAGGTAGCCTTTACAGGGTCTACTGATA<br>TAGGTCGGGTTATCATGGTGGCCGCTGCCCACAGCAACTTGAAACCT<br>GTAACCCTTGAACTCGGGGGAAAATCTCCGTTGATTATCATGGATGA<br>CGCTGATATTGAGGAGGCCGTGAATCTTGCCCACAAGGCCATATTTT<br>TTGGCAGTGGACAAGTATGCTGCGCAGGATCCCGGATATATGTTCAA<br>GAGGGCATCCATGATAAATTTGTGAAGAGAGTAGTGGAAAGAGCGAA<br>GAAACAGGTGGTCGGCGATCCTTTCACCCAGAAGTTGACCATGGTCC<br>TCAGATTGACAAGACACAATTTGAAAAAATATTAGAATACATTGAGC<br>ATGGGAAGCGAGAAGGAGCAAAACTATTGACAGGCGGTAGTCGCGTG<br>GGTGAAAAAGGATTTTACATTGAACCAACCATTTTCTCCCATGTGCA<br>GGAGGACATGAAGATTGGGAAAGAAGAAATATTTGGACCAGTCGTGT<br>CCATTTTCAAGTTCAGGACCATTGAAGAAGCCATAGAACTGGGCAAT<br>AAAACAATATATGGTTTAGCTGCTGGAATTGTGTCGAAGAATATAGA<br>TACAGTCAATAGGCTTTCGAGATCTATTCGAGCAGGAGTGATTTGGG<br>TTAACTGCTACCACGTAGTATTTCCTGATGCTCCGTTTGGAGGGTAC<br>AAGATGAGTGGGATCGGTAGAGAGCAGGGTCTCGATGTTCTTAAAAA<br>TTATTTGGCAGTCAAGTGTGTCATAACTCCTCTCCATGATTCACCTT<br>GGTTGTAGAACTATGCTTTAACCTCTTTCAAATGTGTTTGTCAAATG<br>CTTTCATAGCTTTATATATTTAGGTTGAAGCTTCAATAAATCTTTGT<br>ATGTAAAAAAAAAA |
| 168 | CAATTTCGTCGCAAGTCGATGGAGACCGACAGTCCTCTGGTCGCAAT<br>TTCGTTTCAGCCGCCGCCGGTTGCATTTATTGGGCAAGAATTTGATA<br>ATTTTTTATTTTGAAATTGGACGAATTTCCGTGCATTTCATTTCAT<br>TTCAGGTCTGAACAGTCAGACCAGCGAGCTCTACAAAAGCTTCAGGT<br>ACTGTGAGGGAAGGGCAGCTCGGCGCACCAAAGAGCGGCGAAATAAT<br>GGTGAGGAATTTGCATTGGTGCAGAGCAATTGTTACTATCAGCTCGG<br>CCGTTCTTTTATGTACATTTTGAGCCGTTTTACGATCAATTTCGCCA<br>GCTCTTACGATCAATCCGCTGAGCAGTCTAGTTTAGAATCGGGGCGC<br>CATGAGAAAGAAGGATCTTAAGAAGTTGAAGCTCGCGGTTCCCGCAC<br>CGGAAACCCCTATGTCTGACTTCTTGACTGCAAGTGGTACATTTCAG<br>GATGGTGATCTCCTTCTAAATAGGCAAGGTTTACGGCTTATTTCCCA<br>AGAAGATGATGAGAGTCCATCTCCAATAGAGCCACTTGATAACCAGT<br>TTACTCTGGCTGACCTAGAGACTGTGAGTGTCATTGGAAAAGGAAGT<br>GGTGGTGTTGTTCAACTGGTTCGTCATAATGGACAGGGCAATTTTTT<br>GCTTTAAAGGCCATTCAAATGAGCATTCAAGAGAGTGTTCGTAAACA<br>AATTGTGCAAGAGTTGAAAATAAATCAAGCTTCACAGTGCCCAAATG<br>TTGTAGTTTGTTACCATGCTTTCTATAACAATGGTGTTATCTCTATA<br>GTTTTGGAGTACATGGATTGTGGCTCTCTTGCAGATGTGATGAGTCA<br>AAACATTTACAGAGCCTTATCTTGCAGTTATTTGCAAGCAGGTTCTC<br>AAGGGATTGATATACTTGCATCGGGATAGACATATCATCCATAGAGA<br>TATCAACCATCAAACTTGCTAGTCAATCACAAAGGTGAAGTGAAGAT<br>CACAGACTTTGGTGTTAGTGCAACGCTAGCAAATTCAATGGGCCAAC<br>GCGATACCTTCGTTGGTACCTACAACTATATGTCGCCAGAGCGGATA<br>AGTGGAAGCACATATGGATTTAGCAGTGATATTTGGAGCTTGGGCCT<br>GGTTGTGTTGGAGTGTGCTACTGGTCGTTTCACATACTTACCTCCTG<br>GACAAGAAGAAGGGTGGCTCAATTTTTATGAGCTTCTGGAGACAATT |

TABLE 2-continued

Cell Signaling Gene Sequences

| SEQ ID NO | Sequence |
|---|---|
| | GTTGAGCAACCAGCACCTTGTGCATCGCCAGATGAGTTTTCACCAGA<br>ATTTTGCTCCTTCATCTCTGCATGTGTTCAAAAGGATCCGAAAGACA<br>GAATGTCGGCCACAGATCTTTTGAATCATGCCTTTATCAGGAAATAT<br>GAAGACCAAAATGTTGATCTCGCAGCTTTGCTCAGCAGCTTGTCATC<br>ACCTGTGTAATCATAATAGACATTCAAGTGATGACACCCTATGGTAA<br>AACAATGGTTTCCAGATTCCATGATTGGAATTTAGTTCTGTATAAGT<br>CATAGCTTATCTCAAACTACGTAAATGAGTAAAACCAAATGGGCATT<br>AATATATGCTAGAATTAAGCTGTTGATGTAGTATTGCTTAACTGGCA<br>ATGGGGAGTGAATCTCCACTCAATTATGTGATGTCCTTTATTTAAGA<br>AACCCTAATCATAAAACATCTGTCGTGCTCTATTTAGTCTAAAAAAA<br>AAA |
| 169 | TAGGAGCCGGCTCTGGTTAGTGCTACTGGAGAAGAGGCAGGGAAAGG<br>GGCAAGGGCAGGGGTAGGAGCAGGAGAATTGCTTAGATTGAATATGG<br>CGCTGATGATGGAGTTTGGGGATGAGCTGGTATTGGTGAGGAGTGGG<br>AGGATAATGAGAGCCAGAGAATGGAAATTGACACGGGGAAGGGATAG<br>AAACCCATTTCAATGACATCCCAGAGGTGATAATGAGCAACATATTC<br>AGCGCCATCAAGGACACTCGATCGCGGAACCGGATGGCTCTTGTCTG<br>CAGGAAGTGGCATGAAATGGAGAGGGCGACTCGCGTGTATCTGTGCA<br>TAAGAGGTAACATAAGCAACAACTTGTACCGGCTGCCCATGTGCTTT<br>CAGTCTGTTACTAAATTGGATCTCTCGCTTTGCTCCCCCTGGGGTTA<br>TCCCCCTCTGGATTTCACCACTCCGCACGGTAACTTCATAGGGCATC<br>GGCTCAAACAGGCATTCCCCAGAGTGAACAACATAGTGATCTATGTA<br>AGAAGTGCGAGGAATATAGAGAAGTTGTCCTCTCTGTGGCCTTGTCT<br>TGAGCATGTGAAATTGGTGAGATGGCACAGGCGTGCCATGGATCCTG<br>AGTCTGCAGTCGGTTTGGGAATGGAGCTTAAGCTCCTGATGCAAAAT<br>TGCACAGCGTTGAAGAGCCTAGATCTCTCTCAGTTCTATTGTTGGAC<br>CGAGGACATACCGCTTGCCTTGCAGGCCGAGCCACATGTGTCGGCCA<br>ATTTGTCAAGCCTCAACTTGCTAAAGCTTTCCGCGGAGGGTTTCAGG<br>GCCCAGGAGCTTGCAGCCATATCAGGGGCATGTAGGAACCTTGAGGA<br>GTTGCTTGCCGTTTGTGTTTTTGATCCAAGATACATGGATTGTGTTG<br>GGGATGAGGCTCTTGTTGTACTTGCCAGAAACTGTTCTAGGGTCAGA<br>ATTCTTCATTTGGTCGATGCCACTGCATTTGAAGCTCTCAGAGGCGA<br>TCCGGAAGATATTTTCTCCAGCGAGAATGCCAAGATTACCCGCCAAG<br>GTCTGGAAAGCATGTTCTGGAATCTACCTCTTTTAGAGGGATCTTGTG<br>CTGGATATCTCTCACAATGTCGCAGACTCGGGCCCCGCTTTGGAATT<br>CCTAAGCTCCCATTGCAAGAACATCAAGTCTCTGAAGTTGGGTCAGT<br>TTCAAGGCATATGCAAGGGCCTGAACCCGATGGTGTTGCCTTGTGT<br>ACAAATTTGGAAGCTCTCTTTATAAAAAACTGTTCTGATTTAACTGA<br>CACGGGCCTCGCAGCCATTGCAGCTGGGTGCAGTCGTTTGGGTAAAT<br>TAGAGTTACAGGGATGTAGGCAGATCACCGAGGCTGGTCTCAAGTTT<br>TGTACTAGTCGACTTAGTAAAACTCTTGTAGAGGTCAGGGTTTCATG<br>TTGTAATATCTTGATACTGCTGCCACTTTAAGAGCCCTTGAACCAAT<br>ATGCGAGAGCGTGAGAAAGCTGCATATTGATTGCATTTGGGATAAGT<br>CCATTCTTGATCAAGAAATTGCTTCTCCTAGTCGGAGGTTGAATCCA<br>GTTGGATCTTCTGCCATTTCCACAAGGGAAATAGCTAGCTATGGAAT<br>GGGAAAAACCATCTAGTTTCTGCTGGAGATTGCAATGTCAACAGATG<br>GGACCAGAATCCGGAGAGTGCTTGGGGGCCATCCTTGCAGTTGGCTC<br>CTCCTCAGTTTTGCCCTGACCTCAACTGCGCATTTCGATTTTGGTTC<br>AAGCCCTTCGGATGTACCGATGACAAATTGGGGCCTGGATCTTACCT<br>GACTGCAAGCTCATGCTCAGGGCCTTTAGAAAGTTCCGAGGAAAGAG<br>GCTGTTTGCCTATAGAAATTTCTTCGAAGAACATGAAAAACCGAATT<br>CCCTTGGTTCTGACAGGTACGTGCCTTCCGATGGTGTCATGTTTAGA<br>GGCATGGATGTGAACGGAAAAGCTCCACAGATGGAGCGACTGTGTCA<br>TTCCAATACCGGCACAGTTTCGGATTCGTCATCCACAGAATTTGTGG<br>ACTTTTTGGGGATAAATGACAAGCATCAAGAATGGCAGAAACTTGGA<br>GCAGATATTAATTATGGTATGGAAGTGATGGTCAATTCATCTCAAAT<br>ATGGGGTGTAACAGGGGAGGCTAAAAGAACCTCCTCAGCAACTTAGA<br>AGGTGAGCAGTCATGGACAGAGATCCCCAATCAATACAGTTATAGTG<br>ATTCGAGCAGTCATATCAGATCTATAACTTGGAAAAATCTGCAATTC<br>TTGTCATTGTGGATTCCCGTAGGAGAGCTGTTGTCACCTCTTGCAGC<br>AATGGGTTTAAAAGTATGCCCGCTGCTTGAAGAGATTAGTATCCAAG<br>TAGAAGGGGATTGTAGGCTCTGCCCCAAACCAAGAGAGCGTGCATGT<br>GGTTTAAGTTCACTGGCATGCTATCCTTCTTTGTCAAAGCTCGAGCT<br>CAATTGTGGTGAGGTGATAGGTTTTGCATTGAGCGCACCTGCTGGCA<br>AGATGGATTTGAGCCTGTGGGAACGATGGTACCTCAATGGTCTTCGA<br>GAACTACATCTGTCAGAACTGAATTACTGGCCTCCACAGGACAAGGA<br>TATGAATCGGAGAGGGCTTTCACTTCCAGCTGCAGGTCTTCTTTCAG<br>AGTGTGCAGCTCTTCGGAAACTCTTTGTTCATGGAACTTGTCATGAA<br>CATTTCATGATGATGTTTATTCGCATTCCAGACTTAAGAGATATACA<br>GTTGCGGGAGGATTATTATCCAGCCCATGAAGATGATACAAGCACTG<br>AGATGCGTACTGATTCATGCAGGCGTTTCGAGGAAGCTCTAGCTAGT<br>CGCGGATTTACTGACTGAATTAGGTTTTGTGAAACAGGGTTTATTGT |

TABLE 2-continued

Cell Signaling Gene Sequences

| SEQ ID NO | Sequence |
|---|---|
| | TGATTGATCTTTCCAAGGTCAACTGTGGAGTTTCAGAGGAAGTAGTA<br>TTGTATGATCCTCGTGAAATAACATCCTGAAGGTAGAGCCTGCTTGT<br>GGTGTGCACGACTTGCAAGACAATAACCAGAAATTTGTATGTCAAAG<br>CATCAGAAGACATACAAAAGGATCACTGCCTTTCGGTGTCAGGGGTC<br>TCAGCCATGGATTTTAATATTAATTGTGTCAGTGAAAACTTCTGCCT<br>TGATATTTGGTTCGAGTAATTGGAGATAAAGACTGATTCTTCTTTTA<br>AAACCATTTGGCTGAAGACTCTGAAATAAAGTATAGAATATTACAGT<br>ATGTCCACTCACTCTTCCAGGGTTTCCCCGATGGATTTATGTTCAGG<br>TGCAGCATTCCTCGTCAATGTGTCAGTGGTTATACTTCCTTTGGAA<br>TGTATCTTTCATGAGACTCACTGTTCTTTTGGTGAAGGGGAATCATA<br>TGTCAATCACAATAGGCTGCTGAGGACACAGTAGAACCTAGATTATT<br>TAGTGTAGATGTACCCATTGTATCAATGTCAAATGTCTAATACTCAT<br>TTGATTTTATTGACTGGCCCATACTTGTAACCGGTTCCTTGTTTCAA<br>CTGTTGCTCTTTTGTCCACGGTTGAAAATGTAATTGATGGGAGAAAT<br>AACAACATAATAGAAATACTTGCCTCCAAAAAAAAAA |
| 170 | AGGAGATCGGAATACCACTCAGGTTAACCACATTAGGTAAATTATTT<br>TATGTTTTTAATTGTGAAGGCAGTTAACTTGTCATCTTGTTGTTTGT<br>CCCAGTTAATCATCGTGGGGCTGAACGATTTCAGGGCATGGTTTTC<br>ATTTCCATTCTTTCCACCCCATATTTTTCCTGGTTTCTGAACTCAGA<br>ATGACTTGATTTCCCCATTAGCGTGGAGTCCTAGGTTGCACACATCC<br>TCAAACTCTCATTCTCAACTACGCATTTGTTTAAGACCCTCACTTCC<br>CAAACCCCAATTTGGGTTTCTTTTCAATATTTCCCCTGCGATCGAGT<br>ACATTGGAGATCAGTGAGTGACGGGCAGCACAGGGGCCGAAAGGACA<br>ATTTTCCTGCTTTTTCTTGTTTTTCTGGCAATGCAGATATCAGGCAC<br>TCGCAGGCCTTGCAGGCCATGGGCTTGTGTTGGTTCTCTATGACTGA<br>GCGCAGGAGAATAGATCTAGAATTGTTTATTAATGGGAGGATCAAGA<br>TAAACAGTGGGTTTTTTATCAGAAGCAGAGGCAGATGGGGCAAATGT<br>GGTTGACGTACAGACCAAGCTGAGAAAAGGCTGATTTTTTCCTCTCA<br>TTTGAAGCGCTCCCCATGTGAAAAGATTTGGTATTTGTGGTTCCAGG<br>CAGATTCGCAGATAGTTGAGGCATTGGCCTTGTATCAGGACATAAGA<br>ATACAGCGTGGATCTGTGAACGGAGACAAAGAACTATGCAGCAAGAT<br>CAGAGAAGAAAAGCCCCTACAGAGGTTGAGTTTTTCACTGAATATGG<br>TGAAGCAAGTCGCTACAAGATTCAGGAGGTTATAGGAAAAGGGAGCT<br>ACGGTGTTGTATGCTCTGCAATTGATACTCACACTGGGGAGAAAGTT<br>GCAATAAAAAAAATAAATGATATCTTTGAACATATTTCTGATGCAAC<br>CCGGATTTTACGTGAAATTAAGCTTCTGAGGCTGCTGCGGCATCCTG<br>ATATTGTCGAAATCAAGCACATTATGTTACCGCCCTCTAGGCGGGAA<br>TTCAAAGACATTTATGTGGTATTTGAACTTATGGAATCAGATCTACA<br>CCAGGTTATTAAGGCAAATGATGACTTGACACCAGAACATTATCAAT<br>TTTTCTTGTACCAGCTTCTACGAGCTTTGAAGTACATACATACTGCA<br>AATGTGTATCATCGGGATTTGAAACCGAAGAATGTTTTGGCAAATGC<br>TGATTGCAAGCTAAAAATATGTGACTTTGGCTTAGCAAGAGTTGCCT<br>TCAATGACATGCCGACAACAATCTTCTGGACGGATTATGTTGCCACA<br>AGATGGTATAGGGCTCCAGAGCTGTGTGGATCCTTTTTCTCCAAGTA<br>TACACCTGCCATTGATATCTGGAGCATTGGTTGCATCTTTGCCGAAA<br>TTTTGACTGGGAAGCCCCTTTTCCCTGGTAAAAATGTAGTTCATCAG<br>TTGGATTTGATTACCGATCTTTTTGGAACTCCTCCCATCGAAGCCAT<br>TTCTCGGGTTCGCAATGAAAAAGCTAGAAGATACTTGAGCAGTATGC<br>GCAAAAAACAACCTGTACCCTTGTCCCAGAAGTTTTCAACTGCAGAC<br>CCATTAGCGCTTAAACTTTTGGAAGATTGTTATCTTTTGACCCAAAG<br>GATCGTCCAACAGCAGAAGAGGCTTTGGCTGATCCTTATTTCAAGGG<br>TTAGCAAGTGGAGCGAGAACCTTCAGCTCAACAAATAAGTAAGATGG<br>AGTTTGAGTTTGAGAGGCGAAGGGTAACAAAAGAAGATGTGCGGGAA<br>CTCATTTTTCGGGAAATACTCGAATATCATCCGCAGATGCTAAAAGA<br>GTACCTAAATGGATCAGATAGATCCAATTTTATGTACCCTAGTGCTG<br>TTGATCAATTTAAGAAACAGTTTTCTCACCTTGAGGAACATTATGGT<br>AAAGGTGCACCTGTGGTTCCTTTAGAAAGGCAGCATGCATCTTTGCC<br>AAGATCATCTGTTGTTCATTCGAACACTATGCCCCCCTTGCCAGAGA<br>AAACAATATCAGGTCCTTCAAGGGACCGTACTTCAGAATCCCGTGAT<br>GAATCTTCTAGGTATATTAGGGAAACAGAGAAGCTGCAGCATGATAG<br>GAGTGCAGGAAATGCACTGAAGGCTCCCTTGCAACCACCTCAGAAAA<br>TCTTGCAGGGGGTGCTGCAAAACCAGGGAAAGTTGTTGGACCTTTG<br>CCTTATGAAAATGGTAGTACGAAAGAAGTCTATGATCCAAGAAGGTT<br>GATCAGAAATGCTGTTCTAACAACGTCTCAGTATGCCGCTCCTATTT<br>ACTCATATCCAAGAAGAACTTCAAACACAAAAATTGAACCGAATGAA<br>AAGGAAGACGCTGAGTCAACTTTAATGCCACCCAAGGCCCAATATGT<br>TGGAATTGGTGCAGCAAGGAAGTAGCTGCAGTTCAGAGTGCTTCCTC<br>TCGCTTATATTAAGCAAAATCAATTTCCTGGTAATTGCAATTTGTAG<br>CCCATTTAGACATTGTTGACTGACATCATTCTTTATTACTTGGCATC<br>TTCCAACACTGAAGCAAATTGAGCAACATATCATATCTAGCATGTGA<br>AGAAGATGCTCATGTACAAAAGGTTTTCCCTTTTCATGATGACTGAA<br>TATGGTTCAGTATCAAGCCCAAAAGGGACAACAACCCATGCAGTCCCT |

TABLE 2-continued

Cell Signaling Gene Sequences

| SEQ ID NO | Sequence |
|---|---|
| | CTGTACTGTAAGAAGAGATGAACTCGATGAAATTAGTATTTTATGGA<br>AAATGTAAATGATTTGACTGTAAAAAAAAA |
| 171 | ATCTCTGCTGCTCTGTGTTGGGGATTTTGTCTCGATGGCGCAGCAGG<br>AACAACAGTAGTAGCAGCAGCAGCAGCGGCTGCTTTCAGAGATAAGG<br>AGATCCGCATAGATTTTTTAGTGTCGAGTTAAAATATCTGAATTTCA<br>GTACACACATGCGCGCGTATGCACATGGGGAATTCGGAAGCATCCGC<br>CAATTATGACCACTTACGCGTCCCTCAGTTGGTCCTCTAAGCTATTG<br>CTACAGGGGGTTCAGACGTCTGGAGCACAGTACACTAGAGGATCCCG<br>TTTAGCAGACTAAATCTCAACAGAATTTTGCCTGCTTTTCTCCCTAT<br>ATAACCTCCTCTCTCTCACCGGCTTCGGTTCTGATTTTTCCCGCAAT<br>GGGGCCTTGCAATGGCCGTTTCTCAGCTCTGATTTTGATTTCCATGA<br>CTCCGCCTCCTTCTCGTGTCGGCGTCCTGATCTCGCTCTTTATAATG<br>TCTCTGTTACTGTGTATTTCGGCGCCCTGCATGCACAGCCCTGCGGC<br>TGCCCTGATCGGCTTGAGTCGCTCTGAGAAATACAACACAGACGGGC<br>AAGATCCGTGCCGTCTATCGTTCCTGGACACGGCGGCGGCTGCCATC<br>GACTTCGGCAGGATTTACCATCACAATCCCGCGGCTATCCTCCGGCC<br>GGTGTCCGCTGAAGAAATAGCCCGTTTTCTTCGGGCTATTTATGCGT<br>CGAGGGCGCTCGCGACCGGCTATCGCCAGGAATACCTCACCGTTGCT<br>GCCAAAGGCGCCGGTCACTCCATCCATGGCCAGGCGCAGGCCCCCGA<br>TGGGCTCGTTATTGAGATGTCTTCTCTCAGAGGCGTGCGCATTCATG<br>TGGCGGACCGCGCCGGCGGCTACTCGTACGCCGACGTTGCTGCCGGA<br>GAGCTCTGGGTGGACTTGCTCGCAGAGGCGATGAAGCTCGGCCTCGC<br>GCCTCGATCGTGGACGGATTACTTGTATCTCAGCGTCGGCGGGACTC<br>TGTCGAATGCAGGTATCAGCGGGCAGACATTTCGCCACGGGCCTCAG<br>ATCAGCAACGTCCTGCAACTTGACATAATCACAGGGACCGGAGAATT<br>AGTCACTTGCTCTCCTGCTGAGAATGCGGATTTGTTCTACGCTTCAA<br>TGGGAGGCCTTGGCCAGTTCGGCATCATAACCCGAGCTCGGATTATC<br>CTCGAACCAGCTCCTCAGAAAAGTGAAATGGGTTAGAGCCTTATACA<br>GTGATTTCGAGCAGTTCACAAGGGACCAAGAGCTCCTGGTGTCCATG<br>GACGATGGCGCCGCATCTGTAGATTACTTAGAAGGCTTCGTGGTCGT<br>TAACAACGAGGCAATGCGCAGCTGGTCGATCTCGTTCCGCACTGACA<br>CACCGCTCGATGACAGCGTCTTCAACGACGCTGGAACCGAGATTCTG<br>TTTTGTATTGAGATAGCAAAGTACTTTACACAATCCGACGACGAGAC<br>AGCCGATGTCGACAAGGTCACGGGGCGGATTATCTCGAGATTGAGTT<br>TCATTCCTGGGTTGATTTACAGTGTGGAGGTACCCTACGCCGATTTC<br>CTGAACCGAGTACGAGTGGAGGAGCTGAACCTGCGATCTCGAGGCCT<br>CTGGGACGTTCCGCATCCATGGTTGAACATGTTCGTCCCACGGCGCC<br>AAATTCAACGTTTCACCACTTCTCTGCTCAGGATCATGTCTCCGGAC<br>ACTGTCAAGGGCCCGATACTCGTCTACCCTGTGAAGAAGCAAGTGGA<br>ATACCAACATGTCTGCAGTAATACCTGAGGACAAAGACGAGATCTTT<br>TACGCAGTGGGCGTTCTTCGATCCGCAGACCCACTGTGCTTGGCCGG<br>GTCTTCCTGCTTAACGATTTGCTATCACAGAACCAGCAAATAATCGA<br>TGTATCGACAAACGCAAACGAGATTGGCAACGATAAGACCGAACCAG<br>GCATGGGCGCGAAGCAATACTTAGCCCACCATTCCCAGCAATGGCAG<br>TGGAAGAATCATTTTGGGAGCAAATGGGGAATATTTCTGCAGAGAAA<br>GGCGAGATACGATCCTCTGAACATTCTCGCTCCAGGACAAAGGATTC<br>TCAATAGAAACCACCGAGAATGACCTGACCATGATGATCTGTCCAAG<br>GAAACCAGAGATCTCGCTAACAGCAAGGCCAGTAGTATAATGAATAC<br>AGTAGAATATTATATTTTTATTTCTGTCCTCCCTGTAAGATCCCTGG<br>CACATAATTACAATAAATTTATACTGAACTAAACTTTTTGGCATTAC<br>CCCAAGGTTTTCTCCATACTTTGGTCCATTTATTAGGCCAGCTCACA<br>GTGTGGGTACAAGCCAGTCTGCAATTGCAGTTCAGCAGATGCATCAT<br>CACCTGTAAAAACAGTTTCACCGATTTTTTTTTACAGTGTAGAGCAT<br>CTTCAGGCACAAGGACTACAGTATTACGGCGGATGATCAGTATAGCT<br>GCTGAGCTGAAATTCGCGGATGATTTGTACAGGAGAATTAATGTAAT<br>ACGGATATTTTTACTAAAAAAAAAA |
| 172 | GTTGTTTGTTGTTTGATTCTTCTGAGAGTAGGCCCTGCGTGTTCTGA<br>GACTTTTTTGTCGTTTTAATTTCTATTGAACTTGGCTCGTCATTTGT<br>TCATTTTCAAGTATTGATTTGATGTATAGGAGGTGACAACTTCTGTA<br>AGTTTTTAGATGGATCAGGACCAATCCATCTGCAGATTTGCAGCTCA<br>GAAGGGAAAAGGAGAGATTCAGTCTTCTTCATTCCCAGACGAAGTTT<br>TGGAACATGTTTTGGTTTTCCTGTCCTCCCAGAAGGACAGAAATTCT<br>GTTTCCTTGGTATGCAAGGCCTGGCACAGGGTTGAGGCGTGGACGCG<br>CCAGCAGGTGTTCATTGGCAACTGTTATGCTGTCTCCCCACAGATTA<br>TGATAAAAGGTTTCCCAAGATCAAGTCTGTCTCACTCAAGGGGAAGC<br>CCAGATTTGCAGATTTTAATTTGGTGCCACCAAATTGGGGGGCCCAT<br>CTCACTCCATGGGTGTCGGCCATGGCAACTGCTTATCCATTACTTGA<br>GAGGCTGTACTTGAAGAGGATGACTATCACAGATTATGATCTCACAT<br>TGCTTGCAAATTCCTTCCTATATTTCAAGGAGCTTGTTATGGTTTGT<br>TGTGATGGATTCAGCACAGGTGGCCTCGCTTCGATCGCAAGCAAATG<br>CAGGCAATTGACCACACTTGATTTGAATGAGGACGAGATACATGATA |

TABLE 2-continued

Cell Signaling Gene Sequences

| SEQ ID NO | Sequence |
|---|---|
| | ATGGAGAAGATTGGCTGGCTTGCTTTCCTGAGACTTTGACGTCTCTA<br>AGATCTCTTTGTTTTGATTGTTTGGAGGGCCCAGTAAATTTTGATGC<br>ACTAGAAAGATTAGTTGCAAGATGCCCCTCTCTGAAGAAGCTCAGGC<br>TAAATAGAAATGTTTCTATAGTGCAATTACAAAGGTTGATAATAAAA<br>GCACCACAGCTTACTCATCTAGGAACAGGCTCATTTTTCTATGAGTT<br>CCAACTGGAGCAAGTAGCAGATCTTCTCGCAGCCTTCAGCAATTGTA<br>AACAACTTCAATGTTTGTCAGGATTTCGTGAAGTTGTGCCAGAGTAT<br>CTACCTGCGGTATATCCAGTTTGCTCTATTTAACATCTCTAAACTTC<br>AGCTATGCTGTTATTGGCAGCAGAGAGTTGGAAGGAATAGTCTGTCA<br>CTGTCGTAAATTGCAGCTACTCTGGGTTTTGGATTCGGTAGGAGACA<br>AAGGTTTGGAGGCAGCAGCTACAACGTGCAAGGATCTGAGGGATCTC<br>CGTGTATTTCCTGTGGATGCACGTGAAGACGGTGAAGGTTGTGTATC<br>TGAACGGGGCCTTGTTGCAATCTCCGAGGGGTGTCCAAATCTTGAGT<br>CCATTCTATACTTTTGTCAGCGTATGACCAATAAAGCAGTTGTGACC<br>ATGTCGCATAACTGTTCCAAACTTGCCAGCTTTCGTCTCTGTATCAT<br>GGGTCGACACCAACCTGATCATTTAACTGGTGAACCTATGGATGAGG<br>GATTTGGGGCAATCGTAAGAAACTGCAAAAGCCTAACAAGGTTGGCA<br>GTATCCGGTCTACTCACTGACAAAGCATTTCAGTATTTTGGAGCCTA<br>TGGTGAAAGATTAGAGACCTTATCAGTAGCATTTGCCGGGGAAAGTG<br>ACCTCAGCATGAAGTATGTGCTCGATGGATGCAAGAACCTTCGGAAG<br>CTGGAGATTAGAGACAGTCCATTTGGAGATGTTGCCCTCTTGTCTGG<br>TTTACATCACTATGAAAATATGCGGTTTTTGTGGATGTCTGATTGCA<br>GACTCACTCTACAGGGATGCACAGAGCTGGCCAAGAAGATGCCTGGA<br>CTTAATGTTGAAATAATCAGAGAAAATGAATGCAATGATTCTCTTGT<br>TGAGAAACTTTATGCTTATCGCACTGTAGCAGGTCCACGGAAAGACA<br>TGCCGTCATTTGTAACCATCTTATAGCCACTTCACATGAATTTCGTG<br>GTTATGGCTCTGCTACATATGGGCAACCTGTTAGGGCTATCCTACTA<br>AATTAATCATGCATCAATGTTACTGATGAAAAAGCCCATGTCCATAA<br>TGCCTTTACTTCACCAAAGGAGGAGCAATAGAGCAGGCCAGGTTATT<br>GCCATTTTACTTTGGAAACTTTCTTCAGGTTGTAGCTGCCACCTGAA<br>GGGTTGGAAGAATGTACGATTCACTGATGCAGACTGCTAATTCTTGT<br>TGCTCCCTAAAGTTGAATCTAGTTAAATGCCAAACAATAAACTGGTG<br>ATAGAAATGCTGAAGGTGATGAAAGGTGGAGAATTACAGATGAATCC<br>CTTCTGCGTGCATTGGATAGTGTTTTAAGGGACTGAATGCCTCAATT<br>GGTCTGTTTGTTTTAATTTCAAACAATTGACCTGTCTTTGATGCAAT<br>CTGTGCTTTGACTTGAATTCAATCTGTGATTTGACTTGAATTTTATT<br>TGCTATATGACTGATCCGGAGCTTGTTGAGGAGGTTTGGAATTGTTC<br>CGAGGGAAAATTTCTGAGTTTATCATGTTATACTGATTAATTGCTTG<br>AATTATCAAAAAAAAAA |
| 173 | CTGCAATGGCTTCAACACCTGTGTCTTCCTCTGCTTCTCAGCCCAAT<br>TTACTTCGCCATTACACTCCCACTGTCACAGATTGCTCCTCCTCAGG<br>CTCCTCTATCCCCGTTGTGGATTTGTCTGCACAAAAAACCAGTGTCG<br>TCCAGGCCCTGGTTAAAGCCTGCGAAGACTATGGGTTCTTCAAGGTT<br>GTGAACCATGGAATCTCGCAGGTTTTAATTGATGCCATGGAGGCAGA<br>AGCGGAGAAGTTATTCGCTCTGCCATTGTCTGAAAAGGAGAGAGCAG<br>GACCTGCCGACCCGTACGGGTATGGCAACAGAAGTATTGGTCGCAAT<br>GGGGATGTGGGTTGGATTGAATATCTGCTGTTCAGATCTGATTTTCA<br>ATATGTTCAGCAGCGTTATAAGGCAATTTCGCCAGATAATTATATCA<br>ATTTTTGTAATACTGCCAGCAAATACATAAGTGCAACCAAAAAGCTT<br>GCATGTGATATACTGGAACTGCTAGCAGAAGGGCTTGGGCTTCCTGA<br>AAATATATTCTCAAGTTTTCTAACAGCCGAGGGGAGCGACTCTGCAT<br>TCAGACTCAACCATTATCCGCCATGCCCGGATCCTTCTAACATAATA<br>GGATTCGGAGAACACACCGATCCCCAGATTTTAACCGTTCTGCACTC<br>CAACGATGTCGGAGGATTGCAGGTTTTATCCAGAGATGGAAAGTGGG<br>TTACCGTGTCCCCGGACCCGTCCTCGTTTTCTATAAACATAGGAGAC<br>TGCATGCAGGTACTGACAAACGGGCGGTTCAAGAGCGTGAGGCACCG<br>CGCGGTGACAAACACGCTGCGTTCGCGGATTTCAATGATGTTTTTCG<br>GTGCTCCGGCGTTGGATGCGACCATCGTCACTCCTTCCCAGCTAGTG<br>GACGAAGATCGTCCCGCCCAGTACATGCCCATTCCTCTGGTCTCAATA<br>CAAGAAATCCATCTACTGCTTGAAGTTGGGACAAACTCGTGGCCTGC<br>TCCAGAAATTTCAGGCTTCAATGGTAGGAGTAGGTGTGGCTTAATCC<br>ACTCACCAAATTTTATTCCGGTGGTTACAATCCGATGATATAATGGA<br>GGGGGAGTTGCTTGATCAAATAGCAAACACAGTCAGATGATCAGCG<br>GAGAATTGTTGTACATTTAAGATTTTTAATACAAAAAGTTTTGGAGT<br>AATTGAGTAAATTATCCAATATGGTATTTGACCTCCTAACAAAATAT<br>TTACAAATCAAAAAAAAAA |
| 174 | TTCCGCCCTGCCTATCCTACTATCCTCCCGTTTCAGATCCGTTTCAG<br>TTCAAATGGGTTCAAGCGGTCGCCATGAGAATGAAGCAGAGAAGGTG<br>GTTAGCTGTTATGAAGGGGATACAATAGAGCAAAACAGGGTGGATTT<br>GATGAGAAGTATTATTGAAGTTAAGTACCCATCTGCAAAGGTGACAG<br>ATGATGCTACACTCAGACGTTTCCTACGTGCACGAGATTTAAATGTG |

TABLE 2-continued

Cell Signaling Gene Sequences

| SEQ ID NO | Sequence |
|---|---|
| | GAAAAAGCTTCTCAGCTTTTCCTGAAATATCTAAAATGGAGGCAGGC
GCTTGTACCCCTTGGTTATATTCCAGAGTCAGAGGTCTCCAACGAAC
TCAGGAAGAAAAAGGTTTATATTCAAGGGTTCGACAAACAAAGGCGC
CCTATTGAAGTGATTCTTACTGCAAGGCATTATGCCTCTGACAGGGA
TCTAGAGGAGTTCAAACGACTCATTGTCTATGGTTTTGACAAATTAT
GTGCCAGCATGCCAACAGGATTGGAGACATTTGTCGTCATAGCAGAT
TTCGAGGGTTGGGCTATAGTAACATGGATACCCGTGCCTACCTTGC
GGCACTTGAAATTTTGCAGGATTGTTATCCAGAGCGCCTTGCAAAGG
CATTTATGATTCATGTACCATACCTATTCCAGACAGCATGGAAGATG
ATTTCTCCGTTTATTGACAAAGTAACCAAGAAAAAGATTATTTTTGT
TGAAGATAAACATCTCAGATCAACCTTACTCAATGATATTGATGAAA
GTCAATTGCCAGAAATTTATGGAGGGGCATTGCCTTTAGTACCAGCT
CAAGATTTTGTCATACCCAATTGGTCTTAGATAGATCTAGTTAGGAT
AATTGTTATCTTTTCTTTGGTTGCATAATTTTATAAATTTAATTTTT
TTTTATCCTTTTACATTTAAAAACTGGAAAAGCTCGAACCTTTTTAA
TCTCACTAACAATTTCACTTAAACATGTTGGAACCTGCCATGCTTCT
GTGTTATCTAAACTTGTTATTATAACAACCATGGAAATCTAATATCC
ATGCATTGCCTTCCCTATCATAGGCTAATATTAGGAAGTCTTTTTGG
TATACAGTGATATTCAATGTTAAAATGGAGTGTATGATAAGTAATAA
AATATATAATATTTCCTCATATCACATGATTATATGATATTGTATCA
TAAAAAAAAAAAAAAAAAAAAAA |
| 175 | CTTGAGGAGAGATTTGAGAGTGTTTGTGAAGGGAAGTGTTGTTGTTT
GTGTGTGGGTTTGTTATATTTTTCAAGAAAGATGGCATTCCAGTCAT
TGAGATGGGTAGTCTGATTGGAAATGACAAAGAGAGATTCATGGCAG
AGATGGGAAGGCATGTGAGGAAGTGGGCTTTTTCCAGCTTAAAGGCC
ATGGCATACCAGTTGAGCTCATGGAGCGCGTTAAGAAAGTGTGTTCC
GAGCATTATAACCATGTCAGAGAGCCAAATTTAAGACCGAGTCGGTG
CCAGTAAAGTTGCTTAACAAGTCCCTCATGGAAGCAGAGCTTTCTTC
TAGCGAGCCAAAGAAGGTAGAAAATGTGGACTGGAAGATTGCATTG
TCCTCCAATACGCCCAAGAAGACTATCCATGGCCCTCTGACCCAAGC
GAGTTCAAGGAAACAATGATGGAATTTGGCAAGAGATCACCCAAATTG
GCTGAGAGCCTGCTAGAATTACTAAGTGAGATTTTGGGTTTGGAGAA
AGGGTATCTCAAGAGAACCCTGTCAGGAGGTGATGGCCCTGATGACA
AGGCTTTTTTTGGCACCAAAATCAGCCACTATCCACCATGTCCAAGA
CCAGACCTCGTGGAAGGTCTGCGCGCACACACTGATGCAGGTGGCCT
CATTCTGCTGTTCCAAGATGACGAGGTGGGAGGTCTCCAGGTTCTTG
ACAACACTGGTCGTTGGATCGATGCACCACCAATGAAAGACACGTTG
GTTATTGATATTGGTGATCAATTGGAAGCCATCAGCAACGGGAGATA
CAGGAGCGCATGGCATCGTGTGTTGGCTACTGACAGTGGCAACAGAA
TGTCAGTGGCATCGTTTTACAATCCATCGCTTGATGCAGTCATTTCC
CCAGCTCCAGAGCTCCTTTCGCAGCCCAAGAAAGGCTCGGAGCTATC
ACTGTGTACCCAAAGTTTATGTTCGGGGATTACATGAATGTTTATGCTC
AGCAGAAATTTCTTCCCAAAGAGCCACGATTCCAAGCTGTGGCAGCC
TTGCAGTACTGAGATCAAATAATATTCACAAAGCTTATGTTTATAAA
TACAGTGTTTCTCGGATTTTCGTATGTTTTCTCAAAGTCGTAATAAT
TTGTTTAGAAATTGTTGTACTGTTAATGCCCAACCGGTCTAGGCCAT
GGCCATGAATGAACCAGGTGTGAGGCTCCAGTAAGCTATGTCGTCCA
ATCTAGGTCAGGTTGCTGCATTTCTATGTCTGTATTGAGTCAAGTTG
CTGCTGTCATACTAAATGTTATGTTGGTTTTCTTGGTAGGCTTGGGA
AACGTTCTGTACAAAAGACCATTTTGTATTCCTAGGCTGGTTCTGTT
TACATGGATTTGGATTTTCTGGTTAAAAAAAAAAAAAA |
| 176 | CAGGAATGGCGTCCTATATTCACATCAAGTCTTGAGGCTCCATTCAA
ACGAGCATTCTGGTACTGAGTAATTTCAGGAGATTTGGCTACATGTA
CGCAATCTGCCACTGGAATTAGGCTTGAGGATGATGGAGGCTTTACC
AGATCAGGTGGTGTGGGAAGTACTAGATCGAATTAAAGAAACACGAG
ACAGAAACACTGCAGCCCTTCTGTGCAAACGTTTCTATCAAATCGAG
AAAAACCAGAGGGAATATTTAAGGGTGGGGTGCGGTTTAAGCCCAGC
AATTGAAGCCTTATCCGCGCTCTGTATGCGGTTCCCTAACTTAGTGA
GAGTGGAGATAGGGTATTCTGGATGGATGTCGAAGCTAGGCAAGCAG
TTGGATAATGAAGGGCTTAAAATTCTGTCACAGCATTGCCCTAACCT
CACTGATCTCACTCTTAGCTTTTGCACATTTATTACAGATGGAGGTC
TGGGGTACCTAGGTTCCTGCACTGGGCTTAAGGCCTTAAGGCTGAAT
TTCACTCCAGGAATAACAGGTTGTGGAATACTGTCCGTGGTTGTAGG
TTGCAAAAAATTGTCAACTCTTCACCTGACTAGGTGCCTCAATGTAA
GCAGTGTAGAATGGCTGGAGTATCTAGGTCGGCTTGAGAGTTTGGAA
GATTTGGCTATCAACAATTGCCGGGCTATTGGAGAAGGTGATCTAGC
AAAGTTGGGGTACGGTTGGAGGAACCTGAAAAGGCTTCAATTCGAGG
TGGATGCAAATTATAGGTACATGAAAGTATATGGACGTTTAGCTGTC
GAAAGATGGCAGAAACAATGGGTAGCATGTGAGGCTCTGGAAGATTT
GAGTCTTGTTAATTGCCTCATCAGCCCAGGTAGAGGACTTGCTTGTG
TGCTTAGGAAATGTCAAGCTTTGCAAAATCTTCATCTTGATATGTGT |

TABLE 2-continued

Cell Signaling Gene Sequences

| SEQ ID NO | Sequence |
|---|---|
|  | GTTGGGGTAAGAGATGATGATTTGATAAGCCTTGCCCAGCAATGCCC<br>CAAGCTGAAAACCTTGTCATTACGAGTTCCTTCAGATTTCTCCGTTC<br>CTATCCTAATGAGCAATCCACTGCGGTTGACAGATGAGAGCTTGAAG<br>GCCATAGCTCAGAATTGCTCTGAATTGGAATCAGTTTCAATATCATT<br>CTCTGATGGAGACTTCCCTTCCTCATCTTCCTTCAGTCTTGCTGGCA<br>TAGTTTCATTAATTGAAGCATGCCCTATCCGGGTTTTAGTTCTTGAC<br>CATGTTTATTCATTCAATGACAGTGGCATGGAGGCTCTTTGTGCAGC<br>TCACTTTCTAGAGATCCTTGAACTTATACAATGCCAGGAGGTCACTG<br>ATGAAGGGCTGCAACTGGTCAAGCACTTTCCATGTTTGAGTGTCATG<br>CGACTTTGTAGGTGCTTGGGTTTGACAGATATTGGACTCAAGCCTCT<br>AGTAGCTTCTCATAAATTGCAAAGTTAAAGGTGGAAGATTGCCCTCA<br>AATCTCAGAGAAAGGCACTCAAGGTGCTGCAAAGGTTGTCTCCTACA<br>AGCAAGATCTCTCATGGATTTACTGATGGATGGTTGACCTTCATTTT<br>CTGAATCGTAGAATGGTCCATCCATGGATATCATTTGAAGAAATCAG<br>TGCTTATTGACAGGCATTTTATCAATTAGAGGACAACTTTTATGAAA<br>GCAGGATAATTCTAGGTGTAGTGCTATATGTATTATGAACAAATTTT<br>TTGTCTCAAATTTGCTTCCTGACAGAATATGCTTGGAGTGGCCTTTC<br>GCATATATGTACATGCAAGGCTGTCTAGTGGTTAGCTCTTATCCATA<br>TGCTGGACTGTTGAGCGTTTCAAGAGATCAGCTTTCCTTGACTTGTA<br>TATTTTCTATGTTTGATTTCAGGTTCATAATGTAAATACCTTTCCCG<br>TTGAAAAAAAAAA |
| 177 | ATAGCTATGGCTCTTCAGCTTATGGAAATGGATCTCAAAAGCAGCAC<br>CGACATGGAAATGGTGGAGGAGGTATAAGTTATTGGAATAAGCTTCC<br>CAAGGTCGGGTGAAGAAGGTATAATGGACCCCATGGAAAGGGCTGCC<br>AAGGTCCTGGGATCGAGTCCAGGGCACAAAAATATGATGGGCTGTTC<br>TTCGTCAGGTGTGAAGGTAGAACCTGAGATTGATGGGCTTCTGGCAA<br>ACGCTGGGTATACTGTAAAGGCCTCTGATTTAGCCCATGTTGCACAG<br>AGGCTGGAACAACTGGAGAGCATTATGGGGACGGTTCAAGACCCGGG<br>AATATCTCACTTGGCTTCCGAGGCTGTGCATTATAACCCATCGGATT<br>TAGCTGGCTGGATCGAATCAATGTTCGGGGAGCTTAATCCAGGCGCA<br>GACATGCCAGTTCCGTTTGGGGACAGGGGATCTCTGATCGATTCTTC<br>ACAGGTTCATAAGCCGATTCAGGATGATCCCAGTCTTTCTGCTATGG<br>ACTTGGCGCTCATTCATGAATATGGCTTGCAGTTTAATGGAAGCCAA<br>GCATCTAACCCTCAGGGTTTTTCCCCGGATTCTGATCCCTCTGTTAG<br>ATGCAATATTTTCTCTGGACCGCCTCTGCGTTCTGGGGATTCTACCA<br>CACACACGAACTTTCAGGCGCGGAGCTTTAGTGCCCAGTCCAGCGAC<br>GAGGGTTCGAGTCTCTCTACTACCCGCTTGGGAACCGCACAACAGAG<br>CATAGATAATGGAGCGCAAGAATCAGGGATTCGCGTGGTGCACTTGC<br>TTATGGGATGCGCGGAGGCTATACAGAGAAACAATTTGAAGGTAGCC<br>AGCAATTTAGTCAGAGAGATTCGAATGACGGTGAATTCTGCCCCCTG<br>TGGAGCAATGGGCAAAGTAGCTTCCCACTTTGTTGAAGCTCTGGCGC<br>GGCGGATTTGTGGATTGAATGGCGCAGAATCGAATATGTCACAGGCA<br>GATGCGCAATCGGAGATTCTCTACCACCATTTCTACGAGGTTTGCCC<br>TTATCTCAAGTTCGCTCATTTTACCGCAAACCAGGCCATTCTTGAAG<br>CTTTTGAAGGGCACGGCAGCGTCCATGTGATAGACCTAAATTTGATG<br>CACGGCTTGCAATGGCCGGCTCTGATTCAGGCCCTCGCTCTCAGGCC<br>CGGCGGGCCGCCTCTTCTGAGATTAACAGCCATTGGACCCCGGCAGC<br>CCGATGGCAGAGACGTGCTGCAAGAAATAGGCATGAAGCTGGCTCAG<br>TTCGCCGAATCTGTTAACGTAGAGTTCGATTTCAGAGGTGTCATGGC<br>CGATAAGCTGGAGGATATAAAGCCCTGGATGTTCCAGGTGAAGCCTG<br>GAGAAGTAGTTGCTGTCAATTCTGTTCTGCAGCTCCATCGTTTGCTT<br>TACATTGATGCCCCTACAGGGTCTTCCCCCATTGATGTAGTCCTCAA<br>GTCCATCGGCAGCCTGAGGCCCAAGATTGTGACAGTTGTTGAGCACG<br>AGGCCAATCACAATGGACCTGTTTTTCTGGACAGATTCGTGGAGGCA<br>TTGCATTATTATTCAACCATGTTCGATTCTCTAGAAGCATGCAATGT<br>GCTTCCAAATAGTATGGAGAAATTTTTGGCAGAGTTGTATATTCAGA<br>AAGAGATTTGCAATATTGTTGCGTGTGAAGGTCGTTATAGAATAGAG<br>AGACACGAAACCCTTTCTCATTGGAGGATACGCTTGGGCAGAGCAGG<br>TTTCAGGCCATCACATTTGGGCTCAACGCATTTAAACAGGCAAGGA<br>TGCTCTTGACCTTATTTTCTGGAGAAGGTTACACTGTTGAGGAGAAT<br>AACGGTTCCCTAACACTGGGCTGGCACAGCCGGCCCCTCATAGCTGC<br>ATCTGCATGGCAAGGCTCCTAGGGCTTAGGGTTCAGTTAGTTGTATC<br>ATTTCTTAGCATCTTGCAGGCTCAGTAACTGTATAAGAGGAGAATAA<br>ATCTCAAAGTTTTCAAAGTTTTTAAGACAGTTAAATACTCCTATCCT<br>GTGGTGTCTGGATAAACATACCAGAATCAATGAATGCTTCACAACAA<br>TGTGATACGTCTTTCTCTCTGGATAAGCACATTAGCGTTCAGGATGA<br>AATGCTGGCTCGTAAGATAAATGCTACCAGAATGATTCAAAATGGCC<br>ATGGCTAGGCTAGGCTCATCTAAGCACTGATGTAAAGATAATGAGTC<br>AATCATTTGATGTAAAAACAATGAGTCAATTATTTACTTATTGTATG<br>GTGCTTAACATGGGCAGAAACTCATGCTTACACCTCTTTCTTTTTCT<br>GAATGTATTTTCTTCTCCTTCAAAAAAAAA |

TABLE 2-continued

Cell Signaling Gene Sequences

SEQ
ID
NO  Sequence

178 ATAAGCTTAAGCTTATAGGACAGGGGAGAGGAAGAGGAAGAGGGGCG
AAGGGGGAAAATGGCGTCATAGCAGGTATACGCAGAGCCAATCAACA
GGAAGCAACAATAGGAGAAGCAGCACTAATACTAACACTACCACCAA
CAAAGCAAACGGCGATGGCTCAGTACAATGCGGACGCGAGATTACTC
CAAGTCTTCGAACAGTCCGGGGAATCGGGTAAGTCTTTCGATTACAC
GAGATCCGTCAAGTCCACAACAGAGTCTGTTCCAGAACAGCAAATTA
CCGCATATTTATCTCGAATTCAAAGAGGGGGAAGAATACAGCCGTTT
GGCTGTGTACTAGCAGTGGAGGAGACCACTTTTAGGATCATTGCTTA
CAGTGAGAACGCAGTGGAAATGCTGGATCTGGCGCCCCAATCTGTCC
CGAGCATGGAACAACCTCAACAAGACGTTCTGACAATCGGGACCGAT
GTTCGAACCCTGTTCACTGCTGCTAGTGCTCACTCATTGGAGAAGGC
AGCAGTAGCCCAGGAAATAAGCCTCATGAACCCTATCTGGGTTCATT
GTAAAAACTCCAGAAAACCCTTTTATGCAATTGTGCATAGGATTGAT
GTAGGCATGGTGATAGATTTGGAGCCCTTGAGGACTGGGGATGCGTT
CATGTCAGCGGCTGGTGCAGTCCAATCTCAGAAGCTCGCTGTGAGGG
CGATTTCTCGGCTGCAGTCACTTCCTTGCGGTGATGTTGGCTTGCTG
TGTGATAGTGTTGTGGAGAATGTGAGGGAACTGATTGGTTATGACAG
GGTCATGGTTTACAAGTTTCATGAAGATGAACACGGGGAAGTTGTTG
CTGAAATCAGGCGTTCAGACTTGGAGCCCTATCTTGGGTTGCATTAC
CCTGCCACAGATATACCTCAGGCTTCTCGCTTTCTTTTTATGCAGAA
CAGGGTGCGGATGATCTGCGATTGCATGGCTACTCCCGTGAAGGTTA
TCCAGTCTGAGGAATTGATGCAACCTCTATGTTTGGTGGGTTCGACG
CTTCGGGCACCCCATGGGTGCCACGCCCAATACATGGCCAACATGGG
TTCCATTGCTTCGCTTGTTATGGCTGTGATTATTAATGGGATGATGA
GGAAGGGGGAGGGAGTGGACGAAAATTCCATGAAGCTCTGGGGTTTG
GTTGTGTGCCACCATACCTCCCCGAGGGCGGTTCCGTTTCCTCTCCG
CTATGCTTGCGAATTTCTGATGCAAGCATTAGGTCTTCAGCTGAACA
TGGAATTGCAATTGGCAGCTCAGTTAACAGAGAAACACATTCTTAAG
ACTCAAACGCTTCTCTGTGACATGCTTCTCCGAGATGCCCCAATGGG
AATTGTAACTCAGTCTCCCAGTATCATGGATCTTGTCAAGTGTGATG
GTGCTGCTCTTTATTATGGAGGTATGTGCTGGATGTTGGGAGTGACC
CCAACTGAAGCTCAAATCAAAGATATTGCAGACTGGTTGCTTGAACA
CCACGGGGATTCTACAGGCCTGAGCACGGATAGCTTGGCAGATGCTG
GTTATCCAGGTGCCGCCTCTCTTGGGGATGCAGTCTGCGGCATGGCT
TCAGCTAGAATTACTTCAAAAAGATTTTCTTTTTTGGTTCAGATCCC
ACACTGCAAAGGAGATGAAGTGGGGAGGAGTAAAACATCATCCGGAC
GACAAGGACGATGCTCGACGGATGCACCCTCGTTCCTCTTTCAAGGC
ATTCCTTGAAGTGGTCAAAAGAAGCTTACCATGGGACAATGTGGAAA
TTGATGCAATTCACTCGCTACAGCTTATTCTACGAGGCTCGTTTCAG
GATATTGATGACAGTGGTACTAAAACTATGGTTCATTCTCGGCTAAA
TGATTTGAGATTGCAGGGCATAGACGAACTTAGCTCCGTGGCTAGTG
AGATGGTGCGTTTGATTGAAACAACTACAGCACCTATTTTGGCTGTA
GATTATAATGGACTTGTAAATGGATGAATGCAAAAGTGGCAGAATT
GACGGGCCTCCCGGTTGGAGAAGCCATGGGCATGTCCCTTGTTCAGG
ATCTTGTTTTTGAGGAGTCTGTGGAGAGGGTTGAAAAAATGCTACAC
AATGCCTTAAGAGGGGAGGAAGAGAAAAATGTTGAGATGATGCTAAA
GACCTTTGGCCCACAGAAGGAGAAGGAGGCTGTTATTTTGGTCGTTA
ATGCTTGTTCAAGCAGGGATTTTACAGACAATATTGTTGGAGTATGC
TTTGTGGGCCAAGATGTTACCAGTCAAAGTGGTCATGGATAAATTCA
TCCGAATCCAAGGTGACTATAGGTCCATTGTGCAAAGCCCCAATCCT
TTGATTCCTCCCATATTTGCTTCGGATGAATATGCCTGCTGCTCTGA
ATGGAATGCAGCTATGGAAAAAGTAACAGGCTGGACTCATGATGAAG
TTATTGGGAAAATGCTTGTTGGAGAAATTTTTGGTGGTTGCTGTCGT
CTGAAAGGTCAAGATGCAGTGACCAAGTTTACAATTGTGCTGCACAG
TGCAATCGATGGACAGGAAATAGAGAAGTTCCCATTTGCATTTTTTG
ACAAACAAGGGAAATATGTGGAAGCACTTCTAACAGCAAACAAAAGA
ACAGATGCAGATGGGCGAATTACTGGGTCGTTTTGTTTCTTGCAGAT
TGCCAGCTCTGAACTGCAGCAGGCATTAGAGGTTCAGAGGCAACAAG
AGAAAAAATGTTTTGCAAGATTAAAAGAGTTGGCGTACATACGGCAG
GAAATAAAGAATCCTTTATATGGAATGATGTTTACCCGGAAACTGTT
AGAGGAGACTGATCTGTCTGATGATCAGAGCAATTCGTTGAAACAAG
TGCTGTTTGTGAGAGGCAAATGCAGAAGGTTATGGATGATATGGATT
TAGAGAGTCTAGAGGATGGTTACATGGAGTTAGACACCGCTGAATTT
ATTCTGGGAACTGTCATCGATGCTGTTGTAAGTCAAGGTATGATTGT
ACTAAGAGAGAAAGGATTGCAGCTGATTCGTGAGATTCCTGGCGAGG
TAAAGACAATGCGTCTTTATGGAGATCAAGTAAGATTGCAGCAGATC
CTGGCAGATTTCTTGCTGAATGTGTTGCGGTTACTCCTTCACCAGAG
GGATGGGTAGCAATCAAAGTATTTCCAACCTTGAAACAGCTTGGTGG
TGGTTTACATGTCGTTCACCTAGAATTCAGACTTTGTTGTATGAAGA
GAGCCTTGATGCCAAGATCATTCAAGAACCCACTCTCTTTCCTCCAG
ATAAAGATATAGGATAACACATCCGGGACCGGGCCTTCCAGCAGAAC
TTGTCCAAGATCTGTTTGATAGATCACAGTGGGCCACACAAGAGGGG
GGTTGGACTAAGCATGTGCCGGAAACTTCTCAAATTAATGAATGGTG

TABLE 2-continued

Cell Signaling Gene Sequences

| SEQ ID NO | Sequence |
|---|---|
| | ATGTGCAGTACATAAGGGAATCAGGAATATGCTATTTCCTTGTGAAT<br>GTTGAATTTCCAATGGCACAAAGAGAAGATGCAGCCAGTATAAAATA<br>GACGTGGATTCCTTGTATCATGTTCTGCCAAACAACTCTAAGGGTTC<br>CTTTTCTTCAACTGTAGTGCCTCTCCAGATTTGGTGCAAGCACAGCA<br>GAGAACTCCATGTATATCAATGGTATGAATGCAAGACTGAGCTTCTT<br>TGGCTTCACAGAGGATTCCACTTGTAATGTATGCTCCATTTTTCTGC<br>TTGGCTAATGCTGGAAACATCGAAAAGCATTGTATCACTTGACTTGA<br>GAATTCACGGCACTGGGACGGCTTTTGTAAAAGCTTCAAGTTGTTAA<br>ATCTAGTGACACAACCTCTCTACATGTTCCTCATGAATACTGGTAAT<br>CTGTGCTTCTGAAGGCTGGTAAACATTATTATTGTGTAATCCATTAG<br>CAAGGTCCTTGACAGCATTTTAAGCTGTAAGTTTAGAAGGTTTCAAA<br>TTAACTGTTGTAAAACTAGCAGAGATCCATCATAGTTATAGATATAT<br>TAAGCACTGAAAGGGATAAAAAACTGAACATGCAAAACTCCAAGTTT<br>TTGCACCCTCAAATTCTATTTAATAAACAGAGGTTTGCACGGCAAAA<br>AAAAAA |
| 179 | CGAGGCTCCACCCTTCAAAAAAACCACCATTTCTTTTGATTAGTAAT<br>TTTGGGGTGGAGTGCAGGCATCGAATAATTGAATAGGAGTAAATCGA<br>TTTGGAGCGTGGCCGAACGGAAAACGATCAATTTGGTTTCGTGAAGA<br>GAACAGAAAGAGAAACGATTTGCCAGCCCATCCTCTCCGTAACTTTT<br>GACTTTTGGAATCCTGATCGGAGCATCTTCGGACGGACGTTAATGGC<br>GACTGTGGGCAACAAGAATGTGCAGGCCAAACTTGTGCTTCTGGGTG<br>ATATGGGGCTGGTAAATCTAGCCTCGTTCTGAGATTCGTCAAAGGT<br>CAATTTTTTGCCTATCAGGAATCGACAATAGGGGCAGCTTTTTTCTC<br>TCAGACACTAGCTGTGAATGAAACCAGTGTGAAATTGGAGATCTGGG<br>ACACTGCTGGGCAGGAAAGATATCATAGCTTGGCTCCGATGTATTAC<br>CGTGGTGCTGCAGCAGCAATAATTGTTTACGACATTACAAATCTAGA<br>CTCATTCGTTCGAGCAAAGAAATGGGTTCAGGAACTTCAAAGACAAG<br>GTAATCCAACATGGTGATAGCACTTGCAGGAAACAAGTCTGACATGA<br>TAGAGAATAGCAAGGTTTCACCAGAGGAAGCTAAAGTTTATGCTCAA<br>GAAAATGGGCTATTTTTCATGGAAACCTCAGCAAAGACTGCACAGAA<br>TGTGAATGAGCTGTTCTACGAAATAGCACGGAGATTACCGAAGGCCG<br>AGCCAGTGCAGCATCCTGCTGGTATGGTGCTTGCTGACAGGTCTGCA<br>GAAAGAGCAAGAAGCAATTCTTGCTGCTCATAATATAAGGGACATAA<br>ATATCAATGATCAGAGGCCTGGAAACCAAGCTGGGATAATATTTGTA<br>TTGTGCTATGCTTGAATTTAAGTAGATTGGAGCTGTGAGACAGATGA<br>TTATATTCTCGACTTTTCTGTTGCTAGACTGGCTTTATTTTGGGGGA<br>AAATCATTACTATCTGCATATCTTTGCATTTTCCTTAGGTTACTATT<br>TTTTCGTAGATCCTGGGCACTGTTGAAGACTTGCCCCGAAGATCCCT<br>GTAGTTAAACTGTACATAATGTATGCCAATGTATGTAAGAAATTGAT<br>TTTATCATTTGCAGCTTCTTTAATTTATGCATGTGAGTAAATGCTTG<br>TAATAATAAAGTTTTGGTCAGTTCTGCTGCTTTCCAGGTTAATATTT<br>TGGAACTGTGAAAAAAAAAA |
| 180 | GTCGCGGGTTCGGATTCTTTTCCCTTTCGTCACAATGGCGGATTCCT<br>CAGTGCGCAGCGAGAGCGTGTACATGTCGAAGCTGGCGGAACAGGCC<br>GAGCGGTACGACGAGATGGTGGAGTACATGGGGAAGGTAGTGAAGGC<br>CGCGGACGTCGAAGAGCTGGCGGTGGAGGAGAGAAATCTGCTGTCTG<br>TGTCGTACAAGAATGCCATTGGGTCACGTAGGGCCTCCTGGAGGATC<br>GTCTCTTCCATTGAACAGAAGGAGGAGAGCCGAGGGAACGAGGACCG<br>CCTGCCCCTCATCAGGCAATACAGGCTCAAGGTGGAGGCCGAGCTGA<br>GCGGCATTTGTGACAGCATCCTGGGGTTATTGGATGGCTATCTCATT<br>CCCTCTGCTTCTTGCGGGGAGGCCAAGGTCTTTTATCTCAAGATGAA<br>GGGAGATTACAATCGTTATCTCGCGGAGTTTAAGACCGGGGATGAGA<br>GGAAAGAGGCAGCGGATGGCACACTGGAGGCCTATAAGAATGCACAG<br>GGTATTGCTCTGGTTGAGCTGGCCTCAACACATCCTATAAGGTTGGG<br>ACTTGCACTCAACTTTTCTGTGTTCTACTATGAGATCATGAATATGC<br>CAGAGAAAGCATGTGCCCTTGCTAAACAGGCTTTTGATGAGGCCATT<br>GCTGAGCTGGATACATTAGGTGAAGAATCTTATAAGGATAGCACACT<br>GATCATGCAGCTTTTGAGATAATCTGACACTCTGGACTTCTGACATG<br>CAAGAACAGTTGGATGATTCCTAGTGAAACAGATAACTAAGAAGGTG<br>CATGATCCTCTGGTTCAAGTTGAGATAGAGGTGCCGCACTCATTAGT<br>AGGTTTATCATATGGAGGTGGACTCAATGACAGTTTGGTGGTTTTAT<br>TCATTTTAGTGAGTGGAAGGAGAGGACATTTTTATGGGTCTGCCACA<br>GAAATTGATGGTCCGGCCAATTGTTTGGATGATGTATTAGTGGTACA<br>TTGCTGCATACTTTAATCCAGAAATTCATTACTAAATGATAACTAGA<br>CACATGTGGAAGGATTATCAGATTTTGTTGGATTACACTGGTTTCAG<br>TGTAGTTTGAGACTTTGTGATCCAAATCAAGTTTTATAATATTCTTA<br>TTCATAGACAAAAAAAAAAA |
| 181 | GGGAATTCCCATTCTGCACATGCAATGGACAATGGAATGATGGTATG<br>GATAGTTTTAGCAGGGGTAGTGGCAATGGCAGTGTGGTATCTTTTGG<br>TACAGCACCAACAGCCTAAGCAGAGCCACAATGTTCCTTGGGAGACT |

TABLE 2-continued

Cell Signaling Gene Sequences

| SEQ ID NO | Sequence |
|---|---|
|  | CTTCCACCGGGGGCTGTGGGATGGCCCTTTCTCGGAGAGATCATCTC<br>TTTCTATTTCCGAACACCGGATTTTGTGAAGCAGCGGCGGGGAAGGT<br>ATGGGAATTTGTTTAGAACGTTCCTGATAGGATATCCAATGGTAATC<br>TCAACAGATCCTGAGGTTAACAAGTTTATTCTGAATAATGATGGCCG<br>GCTGTTCGTTCCTGCATATCCGTCGCATTGGTCACAGATAATCGGAG<br>AGTGCAATATCTTTGCTGCTCGTGGAGACTTTCACAAGAGAATGCGG<br>GGAGCTTTCTTGCATTTCATCAGTATTTCGGTAGTCAAGAATCGGCT<br>TCTTTCAGAAATACAAAATATCATAACTTTCTCTCTCGCAGGGTGGG<br>AAGGTAGAATGTGAATGTGTTGCATGAAGCGGAAGAGATGATATTTT<br>CGGTCATGGCCAATCACATGTTAAGTCTTTCAGCGGGCACAGCACTG<br>GAGAGTATGAAACGCGATTTTTTGGTTATGATGAAGGGACTTCGCAG<br>CCTTCCGTTGAGAGTCCCTGGCACAACGTTTTACAAAAGCTTGCAGA<br>AAAAGCAGGTGTTGTTTAACCAAATCAAAAGCATTATTGAGGAGAGG<br>ATAATTGAATATGTCAGCCTATGATTCATATGACGACTTGTTATCAT<br>CCATACTAAGAAGTGCATCAGAAAAAGAATTCACAACAACCCAGATC<br>GTAGATTTAATTGTGCAGTCGGTGATTGGTTCGCTTGAAACTACACC<br>AAAGATAATGGCTTCAGTGGTGCGGCATCTATCTGAAAATCCACATA<br>TCATTATATATCTCAAGGAAGAACACGAAACGATAATCCAAGCCAAA<br>GAAAACAACCAGAGTCTATCATGGGATGACTATAAATCAATGGTCTT<br>TACTAAAAGTGTGATCAAAGAGACTTTAAGATTTGGGATGCAACCTC<br>TCAACAATATAATGTTTAAAAAGACTCTCCAGGATGTAAAAATTGAA<br>GGATATACAATTCCCAAAGGATGGACATGCATAATATATGATTTAGT<br>CTCCGACATGGATACCAAGTACTGCAAAGACCCTCTTTCCTTCAATC<br>CTCAGCGGTGGCAGAGTAAGGAAATGAATGAGGTGCCCTTTTTAGCA<br>TTTGGAGGTGGTCCTAGACTTTGTCCTGGATATGAGTTGGCTATGTT<br>GACTATGTCATTTTTCTTACATCATCTTGTGACAAAATTCAGATGGG<br>AATATCTTCCTTCGAAATCTGAGTTAAGGTGGTTTGATTCACCCTTG<br>AACTCAGTATTCGATTGCAGGATCCACGTAGAGAATCGTTGAATCTA<br>AAGTTAGTGAGATGAACAAGCACCAAAGTTTGGTAGTTGGAAAGACT<br>AAATGAAATCATTATGAGTATATTCTTTTTTTATTGATATTTTTAAA<br>TTAAAACTGATGAGATGAACCTTTGATACTCCTTTGTTGACATCAAA<br>GAGTAGATTGAAATAATTGTCAATATTGTTTATTATTTGTAGATAA<br>TTTTTTTGGTTAGCTGATATTTTAAAGCTAAAGTTAAAAAAAAAA |
| 182 | CTTGAATCTGCCATAGCCTTATCTTCAGCTGCAGTTGAAGCTGGGGT<br>TTTGCAGATTTGGGAATGGCGATATTATACGCATTGGTGGGAGGGG<br>AACAGTGGTTTTAGCCGAATTCAGCGCAGTGGGTGGGAATGCAGGAA<br>CAGTTGCCAGACGAATCATGGAGAAGCTTCCTCTCCAAGATCGCGGA<br>GAAGGAGAAAGTCGCCTATGTTATTCTCAGGATCGCCACATCTTCCA<br>CATATTAAGAGGATCCGATGGATTAACCTTCCTCTGCATGGCCAACG<br>ACACCTTTGGCAGACAAATTCCATTTGCATATTTAGAGGATATTCAA<br>ATGAGATTTATGAAGACATATGGCCGTGTGGCTCAAAAATGCACTTG<br>CTTATGCAATGAATGATGAATTTTCTAGAGTTCTGCATCAGCAGATG<br>GAGTATTTCTCTAGCAACCCCAATGCAGACACCTTAACACGTGTTAG<br>GGGGGAAATGAACGAGGTACGCACAGTTATGGTTGAAACATAGAAAA<br>ATCCTAGAAAGAGGGGATAGAATTGAACTTCTGGTTGATAAAACATC<br>AACTATTCAGGACAGCTCGTTTCATTTCAAGAAGCAGTCCAGGCGAC<br>TACGGCAAGCACTTTGGATGAAGAATGCAAAGCTTTTGGCTTCATTG<br>ACTTGCTTGATTGTTGTGCTTCTGTATATCATAATTGCTTTGTGTTG<br>TGGTGGTATAACTCTTCCATCTTGTCGATCATGATTTTCACAAATCT<br>TGGCCATGGAACTTTCGGATGATGTTCTGTTTGCTTGTCCGTCTTTC<br>AAGGCTATCTATGAAAACATCATCAGTTGTGTGCCAGACCCAATCTA<br>CAGCTTATGATGGTGTAAAAAGGCTGTTTTCTTGGAGATCAGTTAGA<br>CTGATGCAATGAAATTTTGCTCAAGAATCTCAGGCTACTTGGAAGCT<br>TGGTGTGTGGAGGAAGGCTTCTGTATTTATGAGAGATGTTTTCATTT<br>GTAATGTCTGCTCTTTTGCAGATTGGTATAGTGCACAAGGTATTAAT<br>ACTGCACGCGCTTCTGATTCATTGATTAACCCATGGATATAATTTTA<br>ATGGCATTGATAAAACAACAATTTGATCGAGTTGTATGGCTTAATG<br>GATAACATATTCCGATAATTGATTGAGTGTAATTTCTTATTTGAAGG<br>AAATTCTGTCTTAGAGGCCCCATATTCATTGTGTTTATCAAAAAAAA<br>AA |
| 183 | GCCACGGTTGCGGTGGTGGGATGCTCTCCAGCGCTACCTGAGAAGTC<br>TCTTCTTTACAGTATATTTAAGAGGGAAATCGCAAAATCTGGCATCC<br>CATTATGCGGCGAAGGGTTTGAGCTGAGAGCATGGGCATTCTGCCAC<br>GGATACTGAAGTCGTCCCGCCTTTTCTGAGATCAATTGATACACAGA<br>AATTTTATTCGCCCCGTGTTGAAGGGTCTGGAGGAGCTTTATGTGGT<br>AGGCAAGATTGAATTCCGCATCAAGCTACTGATCAGCAGGGTTTATT<br>GGTTTCCAGAATTGGCAAAGAAATGGGGGAATTTAAGAAATGGAAGC<br>GGTGTAATTCACTTCCATCACCGATAAATTCCTTGGACGATGGGTGC<br>CTAATGCGCATATTTTCTTTTCTCTCCCCTTTGCCAGATCGATATAG<br>TGCTGCAAGGGTTTGTTCTAGGTGGAGACATCTGGCATCTGACCCTC<br>GAATGTGGTTACGTGTGGAAAAATCGTGCAATGCATTGGCTGAGTCG |

TABLE 2-continued

Cell Signaling Gene Sequences

| SEQ ID NO | Sequence |
|---|---|
| | GGTATCTTTTCAACGATTGAAGATGCAGTTGTTGCTGCAAGACCAGG<br>AGATACCATATTAATTGCTACAGGAGTAGTTCATATGGCCTGTAATA<br>TTCAAATAGTCAAGCCCATTTGCCTGGTTGGTGGAGGTTCATCACCA<br>GATGAAACTGTGCTTGTTTGTCCGCGGGCTTTGATAGTGCCCTAGA<br>GTTTCTATCCACTGGAAAAGTTGCCAATCTTACCATAAAAGCAGAAC<br>TTGGAAGCTGCTTGCTACATAGAAATGGACGTCTTACAGTGGAAGGC<br>TGTGTACTACAGTGTGAAGAACATCCCTTGGAGCACTTATGTTGTCC<br>AATTGTCAGCACTGCTGATGCTTTAGCCCCTCCTAGTACCTTGTCCT<br>CTGTCATGAAGGGGGGAAGTTCCATGTCTGTTATACATACTCGAATT<br>AAGGTGGTGCTAAGCAGTTTTAACCAATGGGAGCCTCACTCTGCAGC<br>AAGTCAGAGTTATATATTCACCGACTGCCCTGTTTTTCTGGTTTAAT<br>GTTTCACAAAAATCCCTGACAGATATTGATTTGCCACCATTTATATG<br>CAAAGCTTGAGTTGTCTGTCGAGGTTGTCAGCATTTGCAGTTTCTAG<br>CTTATTAGGTGCGACTTCATATTTGTAACATTAAATCCTGTTATCTT<br>ACAATTTACATAGTATCCTGGGAGTCTCTTTTAATTTCAAATATGGC<br>TGTGGGCATGGAGGTGTACAAAAAAGTTATGGATCTGAAACTTTTGT<br>TTTCTTTGAATATACAAACTCTGAGTTGCCTTTAAGCCCGGAGGCAT<br>AATTTGGGTGTCTCTGAGTTGGTAGATCATCAGGGCATAGCTTTCAT<br>AACCGGTAATGGAGTATATGTTCCATGCCTAACAGGTATTGAGATTC<br>AGGTCTATGTAGTAGTTTATCGTATACATCAATCTCTTTGGAAAAAG<br>AGATGCCAGACTTTAAATGATTCAAACGAGCACTTTCATCAAGAAAA<br>AAAAAA |
| 184 | GCCAACTTCTAACTTCTTGGAATCTTCTTGGAATGCCCTAGATGCGT<br>TTTAGTTACCTTCCGCCGCTATCTTTGGCGCCTTCCACTGTGGGTTT<br>GCAGATACATTAATCTGTAGTGCTGGGACGAAGGATTGTTAGCGCT<br>TGTATCCCTGAGAAGTTCGGATACCTTGCATCACTTCAGAGGCATTA<br>CTCTTTTGTAATTCCAACATCATGGGATCAACAAACAACCAGTCAGA<br>GAGAGCATTCTCCATCAAGCTATGGCCTCCAAGTGAGAGTACACGCT<br>TGATGCTGGTAGAACGCATGACTGATAATCTCTCTTCAGTTTCATTC<br>TTTTCCAGAAAATATGGCCTTTTGAGCAAAGAAGAAGCTGCAGAAAA<br>TGCAAAGAGATCGAAGAGACAGCATTTCTTGCTGCAAATGATCATGA<br>AGCCAAGGAAACCAATTCAGATGATAGCTCCGTAGTGCAGTTCTATG<br>CAAGAGAAGCCAGTAGACTCATGCTAGAGGCCCTTAAGCGAGGACCC<br>ACAAGCCAGAAACAAGAATCTGAGAAGGAACTAACGGCTGAAACTGT<br>TGAAGTGAAGGAGACCATTTTTGACATATCAAGAGGTGATCGAGGGT<br>TTGTCGATGGAACCCTTGCTGAGGAGCTCCTGAGACCATTGACAGAG<br>GAAGGGAATAGTTATACCAAGATATGCTTCAGCAACCGAAGCTTTGG<br>TCTCGATGCTGCTCGTGTTGCAGAGAGGGCTTTGATGGAAGTTCAGA<br>GAAATCTGACTGATGTTGATCTTTCAGATTTTATTGCAGGAAGACCT<br>GAGGTCGAGGCCCTTGAGGTAATGACCATATTTGCGTCTGTTTTACA<br>AGGGTGTGAGTTGAGGTCCCTGAATCTTTCTGATAATGCACTGGGTG<br>AGAAGGGTGTAAGGGCATTTGGGCCTCTGTTAAAATCTCAGAAACGT<br>TGGAGGAACTGTATTTTATGAACAATGGAATCTCTGTGGAGGCTGCT<br>AGAGCCATCTGTGAGCTTCTGCCCTCTGTTGAGAGGCTTAGGGTTCT<br>GCATTTCCATAATAATATGACAGGGGATGATGGAGCAGAGCCCCTTT<br>CAGAGCTCGTTAGGAACTGCACTGCATTGGAGGATTTCAGATGCTCA<br>TCTACTAGGGTTGGTGCTGTGGGTGGTATAGCTTTAGTAGGAGCTCT<br>AGGAGCAGGAAATAGATTAAAGAAGTTGGATTTAAGGGATAACATGT<br>TTGGGAAGAAGTGCGGGGTTGCTTTGAGCAGAGCCCTCTCACCGCAT<br>TTGGGTCTTACAGAGGCTTACTTGAGCTATCTGGGTTTTCAGGATAA<br>GGGGACAATAGCTCTTGCCAACAGCCTGAAGGAAGGGGCTCCGTCCC<br>TCAAGGTTCTGGAGCTTGCAGGCAATGAGATTACTGTGAAAGCAGCT<br>ACGGCGTTGGCAGAGTGCCTTGGTTTGAAAAGAATGCTTACAAAGTT<br>AGTTTTGTCAGAGAATGAACTCAAGGACGAAGGATCAGTGTTGATCT<br>GCAGAGCACTTGAGGAAGGTCACGAGCATCTGAAGGAACTTGATTTG<br>AGTTCAAATTCTATCAGTGGAGTAGGGGCGAAGGTTGCAGCTGAGTT<br>AGTTGTCAATAGCCTGACTTCGATCTGCTGAATATTGATGGAAATTG<br>CATTTCGGAAGAAGGGATTGATGCTGTCAAAGATGTCCTGAGAAGAG<br>GTGACAAGGGTGTTACCGTGCTTGGGTCTCTGGAAGATAATGATGCA<br>GAGGGCGAAGGTAATGACTATGAGGACGGGGACGAGGATGATGATGA<br>AAATGAGAGCAGTGATAGTGATGGTGATTTAGTGGCCAAGGTTGAGG<br>ACCTGAAAATGCAGTAGCGCCACGCATAGTCTTCGACATACATTACA<br>AGGACAAATTTGGGTCTTCATTTGCTGTGAAACGCTGATCCCGTGAA<br>GGCAAACTTTCAGAGTTTTAACTGCTGCAGATAAGTCCCTTTACATT<br>AATGATTGGAAATTCTATACCCGGCTAAATGTTGTTTTGTGAACAAA<br>TGAGAAATTTGATTGTGCAGCTTTTGACTGCCCTAGCTTAAGTTCCG<br>TTTCTAGTATTTCACGTTTAATTATGGTTCAGTTAGAATATGTTTAT<br>CAAATTCTTCATCATTCCTAATGATGGTTTTGGGTATTCAAATT<br>CCTTTTAATTTTCTTGCTTAAAAAAAAAA |
| 185 | CGTTCTTTAGCCCTTTTGTTGATTGTATGTGTTGCACAGCCTTTCAG<br>GAGGAGGAGAAGCTAGCGGGAAAAGGCGCGCCGTTGCTGCCGAGGTT |

TABLE 2-continued

Cell Signaling Gene Sequences

| SEQ ID NO | Sequence |
|---|---|
| | TGGCCTTTTGGAAACACGGATCTCTGCGTCCCTTGACGGCATTGAGG<br>ATTTTGATCTTTCGGTTTAGGTTTTATTTTCAGGGAAAATGTCGCCT<br>GCGGAGTCTTCTCGTGAAGAAAGTGTGTATATGGCCAAGCTTGCTGA<br>ACAGGCAGAGCGCTATGAGGAGATGGTAGAGTACATGGAGAAAGTTG<br>CCAAGACAGTAGATGTGGAGGAACTTACTGTCGAGGAAAGGAATCTG<br>CTGTCAGTGGCTTATAAGAATGTAATTGGAGCTCGCCGGGCTTCATG<br>GAGGATAATTTCCTCCATTGAACAAAAGGAAGAGAGTAGGGGAAATG<br>AAGAACACGTTACTATGATAAGAGAATACAGAGGCAAGGTTGAGTCT<br>GAGCTCAGTAATATTTGTGATGGCATTCTACGTCTTCTGGATACACA<br>TCTTATTCCGTCATCCACATCTGGTGAGTCCAAGGTATTTTATCTTA<br>AGATGAAGGGTGATTACCATCGATATCTTGCAGAATTTAAAACTGGT<br>GCTGAGAGGAAGGAAGCTGCTGAAAGTACATTGCTTGCATACAAGGC<br>AGCCCAGGACATCGCGACTGCAGAGTTGGCTCCAACTCACCCTATCA<br>GACTGGGACTGGCCCTTAACTTTTCTGTATTCTATTATGAGATTTTG<br>AATTCACCAGATCGTGCCTGTACACTTGCCAAGCAGGCCTTTGACGA<br>GGCAATTGCAGAGCTTGATACGTTAGGTGAAGAATCTTACAAGGATA<br>GCACTTTGATCATGCAGCTCCTTCGTGATAACCTCACGTTATGGACT<br>TCAGACATGCAGGAGGAGACTGGAGGAGATGAAATCAAAGAAGCTCC<br>GAAGAAAGAAGAAGGTGATGGACACTGAAGGTGATGGACGCTGACAT<br>CTTTTTTATGAATGAAATCGATTAGGATGGTGAAGGGGATGAACGTC<br>AATGTTTATCCGTAAATGACTGTCAAGTAGGTTAGATTCATGAGATA<br>TGGTCAAATATGTTGTATTAGAGGTTTTAGAGTGTTTTTGTGGTTTT<br>CTGCACGATTGTGTGCTAAGGGGGATTCAGCAAATTCTCCTATAAAA<br>TCTGCTGCCCTGCAAGATTTTATTGTTGCAGGGTACTGCTTTGTACT<br>CCAATCATACCATGGAGGGCACACTTAAAGTTGTTATTTAAGTGTTA<br>TTGATGTCATTTGGAAGGATCCCTGCTTGTCAGTGGATGGATATGGT<br>ACCCTGCAGACCTGGGATTGTAATAACATAGTGGATAAATTACTGCA<br>AGTTCTAATATTATACTGTGATGTGCACCAAAAAAAAAA |
| 186 | CAGATTTTGCATGCTCTGTCTTGATCTCTGTGCATTGGCCAACCCAA<br>AGCCAGGCCATTTTCATCTGTATAGGTGTTGGGTGACGTGAAAGGGG<br>CTTTCTCCGGTAAATCTTATATTTACCCTTTGAAGGCCTAAACCTTT<br>CGCACTCCTGTACTCAAATTTGATTTTTACCATTTGGGTCTGTAATG<br>GAGTGTCATTGATTCTGAAACCTTTGGGGGATTTACATTTTACAGTG<br>CAATTTTACTGAGTTTTGTGTGTGAGCGCTGGGTTAAGGTTACTGTG<br>AGGATGGCACGCAAGGTTGATGATGAATACGATTTCTTGTTCAAAGT<br>GGTGTTGATTGGAGATTCAGGAGTCGGGAAGTCGAATCTTCTTTCCA<br>GATTTACTCGAAATGAATTCTGCCTGGAGTCCAAATCTACCATCGGT<br>GTGGAGTTTGCAACTCGAACAATCCAGGTAGATGGCAAGACAATCAA<br>GGCACAGATATGGGATACAGCTGGCCAAGAGAGGTATCGGGCAATCA<br>CAAGTGCTTATTACAGAGGTGCTGTGGGAGCTTTGTTGGTGTATGAT<br>ATTACAAAGAATGCTACTTTTGATAATGTGAAGCGGTGGCTCCGAGA<br>ATTGAGAGACCATGCAGATTCAAACATCGTTATCATGTTGGTTGGCA<br>ATAAATGTGACCTGAACCATCTGAGAGCTGTGCCAATAGATGAGGCA<br>CAGGATTTTGCTGAAAAAGAGGGCCTTTCCTTCATGGAAACATCCGC<br>ATTGGAGTCTACAATGTGGAGAGCTTTTCAGTCAATTCTCGCTGAAA<br>TCTATCAGATTGTGAAAAGGAAATCTCTTGCAGCAGAAGAGGCAGCC<br>TCTTCTGGGCCTAGTCAGGGAACTCCAATTAATGTCACTGATGCTGA<br>AGCAGTTGCAAAAAAGAGAAGTTGCTGCCTTTAAGTTTATATGTGTT<br>CCATGTAATCTAGACATTTTAAGTCCATCCAAGTTGTCTAGGATTAA<br>TTGCTGTTTAGCCAAATATATGTTCTCCGAATTTCCTTGTGTGCTTT<br>GGTTTGTGGTAACTTCTAACATTGGTGAGATTATTTTTATGTACTTT<br>GAGTGTCTGACTAGAGAAGCATCATCGCTAGAATTAAGGAGGATGCC<br>TTGTAAGCTCTGAAAGTTAT |
| 187 | GCAACATTAAAACCTCCGGCACAGGTGCCTCTGTTCAGTGAAGTTCT<br>GTTGCATTCTGTTCGCAGTGAAGAAAAATGAACGCGGGGCCTCTCAT<br>AGCAGCTCTAAGGGACTGCCCATTGCTGGCATTTCCCTCATGGACCG<br>CGGCCGGAATTATTTTGGCATATTTTGTTATATGGCTTTAGCTCAA<br>TTTATCCTTCCCGGAAAGCAGATTCCTGGGGTCGTGCTTGCTGATAA<br>GACGAGGATTTACTATCGCTGTAATGGTTTTATCACTCTTTTTCTGC<br>TGGTTACTCTTTTAGGAATCAGTATGGCAGCAGGGATCTTGTCACTA<br>GCAGTGGTGGCAGACAAAGGTGGGGAGCTACTTTCTACAACACTGAT<br>ATTAAGTGCTTTGATTTCATTATTCTTATATGTTGCTGGTCACTTAT<br>CCCAAAGCAAAATGACTTCTTTAAAACCACATATTACGGGGAACTTT<br>ATTCATGATTGGTGGTTTGGGATACAATTAAATCCACAATTCTTGGG<br>CATTGACCTCAAATTCCTTCTCATTCGTTCTGGGATGATTGGTTGGG<br>CCGTCATAAATCTATCAGTTGCAGCAAAGGCCTTCCAACTGAAGGAT<br>TCATTAAACCTTTCAATGATCCTTTATCAGATATTTTGTTTGTTATA<br>TGTGATGGATTACTTCTGGTATGAAGAATATATGACATCCACTTGGG<br>ACATAATTGCGGAGAATCTTGGTTTCATGTTGGTCTTTGGGGACTTG<br>GTTTGGATTCCATTCACTTTCAGTATTCAGGGTTGGTGGCTTTTAAC<br>ACACAAACCTGACCTTACAAAAGCTGCTGCCATCCTTGATCTTCTAA |

TABLE 2-continued

Cell Signaling Gene Sequences

| SEQ ID NO | Sequence |
|---|---|
| | TCTTTATAATTGGGTATGACAGTCTACGAGGCTCAAATAAACAGAAG
CATATTTTCAAAAAAGATCCAACAGCTTGTATATGGGGTGAGCCTCC
GAAGGTTATCGGGGGGAAATTGCTAGCTTCAGGTTATTGGGGCATAT
CCAGACACTGTAATTATCTTGGTGACTTACTTCTAGCCTTCTCTTTT
AGTTTGCCTTGTGGAGCTAGCTCTTTCGTTCCTTACTTTTATCCTAT
GTATCTGCTGTTCCTACTACTTTGGAGAGAGCGAAGAGATGAGGCAA
AATGTCGCGAAAAATACAAGGAAGATTGGGTTACATACTGCAAACTT
GTACCGTGGAGAATAATACCATACTTGTATTAGTTGTCTCCGACTTT
GAATTTTTCGTTATTCAATGCATGTTTTCTCCTTACAGGAATTGCGA
GCCTCTCGAGTCTTTGGAGAAATTTTCATCTTTATGGGCATTGTTCT
CTAGACTGTGGGGTTCCGACCTGGGTAACTCACAGTGGAGATTGAAA
TGTGTATGTAAATTTTGTCTTTTATCTAT |
| 188 | CTCAATGATCAGACAACAATCTCATCCAGCCGTTCTCACATCAAATC
TTGCGAACTCGGAAATTAGCGTTCAATATACATTGAGTAAAAGCAGA
TACTAGATGATACTTTAAACGCTCGGTCCCGAGTTCGATCACTGTCG
GGTCACGCAACCAACTGCCAGAAGAATGCAGAGGCCGTCGAAGACGT
CTGTGGGCTATGCGATTCCGGACGAGGTTTTGAAGTGCGTGATGGGG
TACCTGGAGGAGCCGTGCGATCGCAGTGCGGTTTCCCTGGTCTGCAA
GAGGTGGAACCGTGTGGATGCGCTCACTCGCAAGCACGTTACCATTG
CGTTCTGTTACACCATAAGCCCCTCGGATCTCGGTGCACGGTTCCCC
GAGCTTGAGTCGCTGAAATTGAAGGGAAAGCCCAGGGCTTCCATGTT
TAATTTGATTCCCCAGGACTGGGGCGGATACGCGGAGCCGTGGATTA
ATGAGATTTCCCAGACGTTGCTCTGCTTAAAGGCTCTTCATTTGCGC
AGAATGATCGTTACGGATGAGGATCTCAGGGCTTTGGCTCGCGCCCG
CGGCCACATTCTGCAGGTTCTTAAACTGGAGAAGTGCTCGGGGTTTT
CGACTCTCGGGCTTCTCGAAGTCGCACGGTCCTGCAGATCTCTTAGG
GTCTTGTTTTTAGAGGAAAGTACTATTGAAGATGAAGGTGGAGAATG
GTTACATGAGCTTGCTCTTCATAATTCTTCATTGGAAGTTTTGAACT
TCTACATGACAGGTTTGGAAAATGTTAATGTTAATGACCTTGAGATG
ATAGCAACAAACTGTCGATCTCTGACCTCATTCAAGATAAGTGAATG
TGATATTCTGGATTTAAGAAATGTATTCAAGAAGGCCACAGCATTGG
AAGAGTTTGGCGGTGGGTCATTTAGTAGCAGTGAAGAGCAGGCTGTA
GAACCAAATATTTATGAAATGGTTAAATTCCCTACAAATTTGATGTC
ATTGTCAGGACTGAATTACATGAGTGAGACTGAATTACCAGTTGTAT
TTCCACGAGCATCTTCACTAAAGAAACTGGATTTGCAGTATACACTT
TTGAGCACAGAAAACTATTGCCAGTTGTTACAGTCGTGCATTAATAT
TGAAATTCTTGAGGTTACGAATGCGATTGGAGATAGAGGGTTAGAAG
TAGCAGCTGAGAATTGTAAAAAATTAAGGCGACTTAGAGTGGAGCGT
GGGGAAGATGAAGCTGGTTTGGAGGGTCAGCAAAACTTTGTTTCTCA
CAAAGGGCTTTCAGTTATAGCTCAAGGCTGTCCCAATCTAGAGTACA
TTGCTGTGTATGTTTCAGATATGACTAACTCAGCCTTAGAATCTGTT
GGTAAATTTTGCAAAAATCTGAGGGATTTTCGGCTAGTCTTGCTAGA
CAAGAAAGAACAAGTGACTGACCTCCCACTAGACAATGGTGTCATGG
CTCTGCTGCTTGGGTGCCAAAAGTTGAAGAGGTTTGGATTTTACCTA
AGGCCTGGAGGATTGACGGACATAGGCCTTGGTTACATTGGAAAGTT
TAGTAGCAATGTGAGGTGGATGCTTCTGGGTTATGTCGGAGAGACTG
ACTTTGGGCTTCTTGAGTTCTCGAAGGGATGCCCAAATTTGGAGAAA
CTTGAATTAAGGGGTTGTTGCTTCAGCGAATATGCATTATCTGTGGC
AGCGCTTAGCTTGAGGTCTCTAAAATATATCTGGGTTCAGGGCTACA
ATGCAACGCCATCTGGATTTGATCTTCTAGCTATGGAGCGCCCTTTC
TGGAACATAGAGTTTACTCCAGCTTCTCAAGTGACAGTGGATGGTTT
TAATTTGGAAGAAGAAATTACAGAGAAGCCAGCACAGATATTGGCTT
ATTATTCGCTTGCAGGAAGACGAACAGACCATCCAGATTCAGTAATT
CCTTTAAGCTTATCCTCATGGAATCGTCAGCTCCAGCATGTATATGA
ATATTCTCTTTTCCATGCATATGAATATTAAGTTGCTGTGTTATAGT
TATTATTGGTGTGGATCTATGTACATTTTAAACCTTCTAAGGAGTGG
AGCGTATAAATGGTTATGGTGTCAGTTATACTTCCTCGGCATGCCTT
TTGAAAACTATAAAGGCAAGAAGAATTAGCCACGCATGGCCCTTGTG
CCTGTCTTCCGCCTGCAAGCATGGATTTTATGCTGACTGCTTCAACG
TTATATGGAGATGGATTCCTTAATCTGTCGCATTTAAGAGGAAAGCC
CTGCTTTGTCAAATCTTATGCCTGCTGTCTGTATATTACGCAGAGGA
TTTGTCCATCTATAACATGATCGTCGATCGTCACTACTTTACCACAG
AAATGAATGCAGGCAACTCCTTGAGGAGCTTCTAGATCTATTCTTTC
TTGAGGCTATCACATTCTAGAAGAAAATGGTGGCTTACTCGAAGCTG
AGGACTCAGAATGTATTTATGCTTGAGATTACATCATATTAACATGT
AAGTTTATTGGAATCTGAAAATTCCTGATGTATCCATTTGTGGGACT
TTCGGTCAGTACAAAAAGACTCAACATATGCCAAGGATTCCTGATTT
GATTTGAGGTAGAGAAGGGTTCGGAGTTCTCATTTGAGATTATGGCA
AGTTAGAAAATCAGAAGGATGATTAAAAGCTGAAGATTCCTTGCATT
TAGAATTGGGATCAGACTTCTAAAGCTAAGCCTGGTCTATCTGTATT
TCTCATTTCACCATTGCGAGGTTTGCATCTTTAAATCATGGATTTCT
TTCAATAATTTGTAGCTTTCTCGTGCTAACAAGACAAATTTCTGCCT |

TABLE 2-continued

Cell Signaling Gene Sequences

| SEQ ID NO | Sequence |
|---|---|
| | AGTGTGGAGAGTTCAAAGCCTACAGTTTGATTTCTTTTTCTTTTCGC<br>TAAAGAAAATTGATTCGCATAAAGACAAAGGACATACTGCTACTATG<br>TTTGTAGAATCCACAATTATTTGTACATATTCAATGTGTTTATATA<br>GCTTAATACAAGTAGTCTGTACGTATCCTGTAAAAAAAAAA |
| 189 | GGTTGCAGCATGCTTCTCGATTCGATGATGAGATAGTGATATATGAT<br>TACCCATATTTTACTTGGAGTGCAGACGCATGCCATGCTGGCATGCT<br>CTGTGGACAACGTCGAGATTTAAGATACACCACTGGAGAAGATCTCG<br>GGGATGACTACAAAGATCGGTGGTTAAGACCTCACATAGATAAAGGA<br>TGGAGTAACGGCCATTCCGCAGATTGGAACCCGCGATTCTGCTATTC<br>ATTCTTCTTCTCCTCGACTTAAATCTTCGCAGATTTGATAGATATTC<br>ATTTGCCCGAACGTTGCTAGGGCCCTGACCATCAATGGCGAAGTTAT<br>ATCTTTTCGTTGCGGCTTTGCTTCTACTTTCTGCTTCATCAGCTGCT<br>TCCCAGTCGTTGAATACCTCCAGTGATGCGATCCCGGGGAAAGATTT<br>CAGCACAGGCAAACAAGTGTCGAGTACTTGCGATTGTTTGCGGAAGA<br>TATCAGCTGGTCCAACAACCTGGTGCTTGGGCTGCTAGTGCCCCGAA<br>GCATTTGGTCGCCTCTGCCTAGGGTTTTGCAGACATGGCTTCGTAAC<br>TATATTGCTGGAACTGTTGTGTATTTTGTATCCGGAAGCCTTTGGTC<br>CTTTTATATTTATTACTGGAAGCGCAATGTCTACATCCCGGCAGATA<br>GTACACCTTCAAAGGAACCAATCTTCTTGCAAATAATGGTGACTATG<br>AAAGCCATGCCTTTGTATTGTGCTCTTCCTACGCTGTCAGAATACAT<br>GATTGAGAATGGTTGGACAAGGTGTTATGCCGCTATAAATGAAGTTG<br>GGTGGCCTTCTTATATTTTATTAACTATTCTATACTTACTGCTGGTC<br>GAGTTTGGGATTTACTGGATGCACAGAGAGTTACATGACATAAAGGT<br>TCTATATAAGTATCTCCATGCAACTCATCACATATACAACAAACAGA<br>ATACACTATCTCCTTTTGCAGGATTGGCTTTCAATCCACTGGATGGC<br>ATATTACAGGCGATTCCCCATGTTATTGCTTTATTTATCATACCAAC<br>ACATTTTTTAACCCATGAGCTGCTTCTATTTTGTGAGGGAATCTGGA<br>CAACCAACATTCATGATTGCATACATGGTAAAGTTTGGCCTATTATG<br>GGAGCTGGGTATCATACTATCCATCACACAACATATCGACACAATTA<br>TGGCCATTATACAATTTGGATGGACTGGATGTTTGGAACACTTCGTG<br>ATCCAACAGCTGAAGCAAAGAGCGTGAAAAATATGTGATTTCCAGCT<br>TTTCTATGCAGCCGTTTCTCAAAAGATCTTTTAACTGGTTGTGCTGT<br>TTACTCGCCAAAGAACTTTTTTCTACATTTAGGGCCATAGAATAATT<br>TTTTTTGTATATTCCGTGTAGGCAGATGTTGTACTTCTCGAAGTTTA<br>TTTATTTGGGAGCAATCGGCTTTTTATGTGTAAGTTGTAATTTGTGA<br>TATCAAGCTCTGGTTTAATGTTGTAAAGACTTGGTGAGACGGGCTGT<br>GGAATTATTTTTATCAACATAATTAGGTGTACTTTCATATTTCATTT<br>TAAATCTTGGCTCAAATTATTGTGAAGGCATTTCGGTTCTGCTTTCT<br>TTGTAACATTTGTAATAGGCGAAGTCTGTCTGCTTTTTCGATGTATT<br>TGAACTTAATTCTGTACAATAGAACATAACACATGTTTGCCATGTGT<br>TTAAGATTTCCGCATGTATACCGGCACTATTAACATATGCAAGTATT<br>CATTGAGGGTTTTTACCACTATAGTTGGCATTGCTTTTAATGTCGGA<br>CAGTCCCTAATTATTTAAAAAAAAAA |
| 190 | GCTTTCTACTGCTTCCTTGGAATGTCTTCTTTCGGCTTTTTTCCATG<br>GTAGCAGTCGTGCCTATCAGTTGAACCTTCTCTTCCTTACCTTTTCT<br>TTCTTCTAACTTCTTCCATGTAATTCTTTCTTTGGCTTTTATCCATG<br>CTATCAGTTGTGGCTATCAGGAGTAGCTCGGTTACCTTCTGAAATTT<br>GCTTCTTGAACTGGTGAAGATATATGAACGCATGCATTCAATTTGCT<br>AGAGATAAAACGTGGCCAATTTCTCTATATTTCAACGTTTTGGGATT<br>GTCGGCATTGTCGTAATGGCTTATAAAACGGAGGAGGACTACGATTA<br>TTTGTTTAAAGTTGTGCTAATCGGAGACTCAGGGGGTTGGGAAGTCCA<br>ATTTACTTTCGAGATTTACTCGAAATGAGTTCAGTTTGGAGTCCAAA<br>TCAACAATAGGTGTGGAGTTTGCGGCACGCAGCGTCAACGTGGACGG<br>GAAAAGTATCAAAGCCCAAATCTGGGATACAGCTGGTCAAGAAAGGT<br>ACAGGGCCATCACAAGTGCATATTACCGTGGAGCTGTGGGCGCCCTG<br>CTGGTGTATGACATTACTCGCCATGTGACATTTGAGAATGTTGAGAG<br>GTGGTATAAAGAGCTCAAGGATCATACAGATGTCAACATTGTGGTGA<br>TGCTAGTGGGAAACAAGTCTGATTTACTGCATCTGAGAGCTGTTTCT<br>GTTGAAGAAGGGAAATCGTTTGCGGAGAGGGAGAGCCTCTACTTCAT<br>GGAACATCTGCATTGGACTCAACAAATGTGGAGAACTCCTTCACACA<br>GGTGTTAACGCAGATTTACAGAATAGTGAGTAAAGGAGCTTGGATAC<br>TGCAGAGGAAGCTTTATCAACACTGCCAGGCAAGGGTCAGTCAATTT<br>CTGTAAATGGCAAGGATGAGTTCACTACCAAGAAGGCTGGATGCTGC<br>TAGTTCTACCCATTGAATGCATTTTCTTTTTCTCCCCTCGTCAATAT<br>TTTTGTTAATCAGGTGCCATATGTTATTCTTGTAATGTTCAATTTGA<br>TTCCATATGTTACTCTTGTAATGCTCAATTTGATTTGATTCCAGTTG<br>ACTTGTTCGAAAACGTCCATTTTTCAAACTTCCATCAGTCTCCAAAG<br>GATTGATGTATGGCCATGCATTCGCTATAGCATAGTGAAGCTGGGTT<br>TATACTCAGAAGTGTAGAATCTTTGGTGTCGTATAGACGAACCATTT<br>TGCACATTTTGAGATTGTTGTAATTTCTATACGTAGTACGTTTTTGA |

TABLE 2-continued

Cell Signaling Gene Sequences

| SEQ ID NO | Sequence |
|---|---|
| | GATTTTGTGTGTTATAAAGCCACATGTTATGCTTTCCAAAAAAAAAA AAAA |
| 191 | CCTTCTCAACCACAACCATCATCCCCTCGCACTCTCCACATCATCTC CAGTCCCCATTTCCTGTTTCTATTCTTCTATATTAACTATGCCTGAA CTCGTGAAGATTCCGTCTACCTCGCCAAGCTCGCTGAGCAGGCTGAG CGTTATGAAGAGATGGTTGAGAACATGAAGCGTGTGGCTTCTTCTGA CCAAGAACTCACTGTCGAGGAACGCAATCTGCTGTCTGTCGCGTACA AGAACGTTATTGGTGCTCGCCGCGCGTCCTGGAGAATCGTTTCATCA ATTGAGCAGAAGGAGGAATCTAAGGCAATGAGGCTCAGGTGTCAATG ATCAAGGATACAGGGAGAAAATTGAGAGTGAACTCGCCAAAATCTGC GAAGATATTCTCGATGTCCTCGATAAGCACCTCATTCCCTCAGCTGC CTCTGGGGAGTCCAAGGTCTTCTACCACAAGATGATGGGCGACTACC ACCGCTACCTCGCAGAATTTGCCACCGGTGATAGCGGAAAGATAGCG CCGACAAGTCCCTCGAAGCCTACAAGGCCGCATCGGAGGTTGCCGTC ACCGAATTACCACCTACACATCCCATTCGTCTTGGTCTCGCACTGAA TTTCTCGGTATTCTACTATGAAATTCTCAATAGTCCCGACCGTGCAT GCCACCTGGCCAAACAAGCGTTCGACGATGCTATTGCCGAGCTTGAT ACGCTCTCGGAGGAAAGCTACAAGGATTCCACTCTCATCATGCAATT GCTTAGGGATAACTTGACGCTCTGGACTTCGGACATGCAAGACTCTG CCGATAAGCCCGCCGACTCGAAGGATGAGCCCGCTGAGACACCTGCA GAGGATTAGATGTTTCCGTATGCATTTATTGTCTCGGAAGTCTTGTT ATTTCTAGGCTTTTGTTCTTCAATTTTAATCAATCATTTGTTGAATT TGTCGTTCGTCTGTTTGCGCTCTCATTATATCTCTGCATTTGTGTCA TCCTCCATTCCTCTCATCACGTCCATGTGTCCCCTTCCCTTATTACT CCCTATCCCTTCCCCTCCAGTATTATGCTCGAAATGGTTTCTTATAC TCCTTACCTTCAATGATGATAGAGGCGGTTCGAGAGCAAAAAAAAAA AAAAAAAAAA |
| 192 | CCCACTCCCGCTCAATCCGACAACTTGTTTTGATAGTCCATGTCACG TGCGGGCTGTGTTTTCCTGAGCGACCCAATTCTCCCTACAAGTCCCG CCCACGACTATCTTTGCTTTCAACGACCCCCCTTCGACGCCAACATT ACTCGAACTTGCTAGAATACCCTCTTTCCAACATCTATCACAATCTT CCACAATAGAAATCATGGCAAACGAACGCGAGAGCAAAACCTTCCTC GCCCGGCTGTGCGAACAGGCTGAGCGCTACGATGAGATGGTCACATA CATGAAGGAAGTCGCAAAGATCGGCGGTGAATTGACCGTGGACGAGC GCAACCTTCTCTCAGTCGCATACAAGAACGTAGTTGGCACACGACGT GCGTCGTGGCGCATCATCTCCTCGATCGAGCAGAAAGAGGAGTCAAA AGGCACCGATAAGCACGTCGGCACCATCCGCGATTACCGTCAGAAGA TCGAGACGGAGCTCGAGAAGGTGTGCCAGGATGTCCTCGACGTTCTT GATGAGAGCTTGATTCCCAAAGCCGAGACTGGCGAGTCTAAAGTATT TTACCACAAGATGAAGGGCGACTACCACCGCTATCTCGCCGAGTTTG CCTCGGGAGAGAAGCGCAAGAATGCTGCGACCGCCGCCCATGAGGCC TACAAGAGCGCCACCGATGTTGCGCAGACTGAGCTCACTCCCACTCA CCCCATCCGCCTCGGTCTGGCCCTGAACTTTTCTGTGTTCTACTACG AGATCCTCAACTCACCCGACCGCGCTTGCCATCTTGCAAAGCAGGCA TTCGACGACGCCATTGCCGAGCTCGACTCTTTGTCTGAGGAGTCTTA CCGGGACAGCACCCTCATCATGCAGCTTCTGCGTGATAATCTCACCC TCTGGACATCTTCTGATGGTGCTGAACCAGCTGAGACTGGTGAGGCA CCAAAGACCGAAGAGGCCAAGCCAGCTGAGACTGCCGAAGCCGCACC CGCCGAGCCCGAGAGCAAGCCAGCCAAGGAGGAGGAGCCCGCCGCCC CAGCTGCAGCTTAAATTATCAGCTGACATGGACAATGCATGCTGTTG CGAACCGATTGAAGCTTGGTCCATCATGCCTCGAGACTGCCCAATCT ATGTTCTCGAGACTCAGTCGCAATGGACATTTCTTCAGTTCTTCGGG TTTATGCAGGTTAACGGGTTGATGCGGTGTTCTGCTTCTTATCATCA TGCGAAAACTGGTTCATTATAGCAAGCGGGTTTACGAGTTCTCACAC GTGTCATGTCTTATGGGCCCCTTCTTCCCTTATCTCTCCGATCCTCC TTTGCTTTCCTGCTTTATAGCCCCGGTATACTTTTGTTTTGTGCAAT CTTTCTGGTGGGATACGCTGGTGGATGGATGTTTGGCAGTTGTAAA GTGAGTAGGTCTTCTATGGACTTACTCGCAAGCAGCTCGACCGTGAT ATCTGGGTATAACTAACTAGCTATAAATTGATCATATTCAATTTGAA AAAA |
| 193 | GTAGATAATCACTACCTTCTATTTGCAGACACCTATTTCTGTGCATC GTGCCTTTACCCTATCCAGGGTTTCCAAATATTTATAAATTGTGTCT CCCAGGTTTCGGATAAATTCCAGTTCCACTGCCTCCTACGAATCCGG AATCTTCATCAGTTGCCATGGACGCTCTTCTGAAGCAATTTGAAAGA CTTCAGAGACCAATTGATCTGGTGCAGACGCTACATGAAACCCAAGT GAAGCAAGTCCCTGCACGCTACATCCTTCCTTCGGAACAGAGACCAT CTCGTCCTCTTCAAGTCCAGCAGTCTCTTCCTGTCATTGATCTTGCA GGTCTGGAAGATACTGATCAACGCATCAAGATTGTCAGTCAAATAGC CCAAGCATCTCAGGAATGGGGTTTCTTCAGATAATAAATCATGACA TACCTGTGTCATTGCTAGAGACTGTGAAGCGTGTTTCACAGGAGTTC |

TABLE 2-continued

Cell Signaling Gene Sequences

| SEQ ID NO | Sequence |
|---|---|
| | TTTGATCTTCCTCTTGAAGAGAGACGGAAACAGTGTCCTGTCAGGCC<br>TGGTGTTCACATGCTTGAAGGCTATGGCCGGTTCTTTGACATCTCTG<br>ATGACACGGTCCTGGACTGGGTTGATACCCTAGTTCATTATATTTCT<br>CCAGAGTGGGCCAAAGCAGTTGAGCACTGGCCCAAAACCCCTCCACA<br>TACAGAGAAACATATGAAAAATACGGTGAAGAGGTAATGAAGGTTAT<br>GGAGAAGTTGCTGGGTCTTCTTTCCCAGGGTTTGGGGCTGGACCCAA<br>AGTATATCCAAACCCTCAATAAGGAATCCCTGCTACAAGTCAGAATC<br>AATTATTACCCTCCTTGCCCTCAGCCAGATATGGTGAATGGGTTTAA<br>ACCCCATTCAGATGTCGATATGCTCACTGTTCTGCTGGATGATGGGG<br>TGGACGGTCTCCAGGTTCGGAAAGATGAGGATTGGTTCACTGTGCCC<br>TCTATTCCTGGAGCTCTTATTATCAACATCGGGGATTTGTTACAGAT<br>AGTAAGCAATGGGAAATACAAGAGTGCCGAGCACGGGCAGTAGCGA<br>ATACAAAGCAGAGTCGCATGTCTATGGTCATGTTTTTGAGACCACAA<br>GAGGATGTGTTGATTGATACTGCTCCCGAACTGATCGATGAAGCTCA<br>TCCCAGCTTGTACAAAGCCGTTAAAGCTGGGGAGTACGAAACTGAGT<br>ATAATAGCAAGGATTTCGAGGAAAAGACGCTGTACATACTTTACGT<br>ATAGAACAGGCGTAGGAAGTCAATGTCTAGTCCTTCAATTGCATTTT<br>TATAAGATGTCTATCTAGAGAACTATTCAAGGTATTTGAGTGGAAAC<br>TATAACTATAAGATAGCTGTAGGTGTTTTGAGTAAAAGATGTAATTT<br>GCTAGCATATTATATATGCAAAATAAACATAGGGGTATTTCATTGTT<br>TTGAGTGGGTGTTTCAGTGCCACGTGTTTGGGCATTTTGAGTGGGTA<br>TTTCATTGTTTTGAGTGGGTGTTTCATTGTCACTTGGTTGTGTGCGT<br>TTTGAGTGGAAGATGTAATTTAGAGGGTATAATATTTTGTTTGGAAGT<br>CCCTACTTATTAGATTTTTGGAAATTTGGTTAAATATTGATTTGTCT<br>TGTTTAAATTGGTTTTTTGATATATGGATTTAGCAAGCTTAAAACTT<br>TTTGCGACAAAAAAAAAA |
| 194 | CTCGCGTTCAATTCTGCAAGTGGGCCATTTGAATTTTCCACAGAAAC<br>ATAACCCTAGATTGGTTTGGAAGGTCGAGTTCGATTCTCCAGGTCTG<br>TATGCTTTCCTATATGTTTTTAGCCTTATCCTTAAGATCATTTTTCG<br>GGTCTCAGAAAGAGGTTGATTGGTTATAATAACCAGAATAAATGATG<br>GAGTCTCTGCGAAAACTGGTGTATTATGCTTGTGTTTCGAGAGGCCC<br>AGTAATTGTTGCCGAATACAATGATTTAGGGGACGCGGAGCAACTGG<br>CAATAGCTGTTGAGTGCTTAGGTAGAGCCCCTCCATTCCACAGCAGA<br>TTCACACACACTATTAAAAACAGAAGATACAGTTTTCTCATGGATTC<br>TGAGTTTGTATATTATGCAATAGTTGACGAGGCCCTTCCGAAAGTGA<br>AAGTTTTTTCTTTCTTAGAGCAGGTGAGGGATGAGTTCAAGAGACTG<br>CTCAGGGCCAAGGGTTTGTCAAATAGTAAGGACGAAATCCTGCAGGG<br>TTGTGGCCTGGGTGATGATTTTGCCTCCACATTTAGACGCTTGGTTG<br>CCCCACTCGTTGGGATCCCCCAAACCGAAAAGCGCAGGATGGAGGAA<br>GAAGAAGCAAGTGCCCGCCGGCAAGAGGATGAGACCGAGACCGAGGT<br>TTGCTCCCCACTGCTTCGGCACCACTGTATGGGAAACCCCAACCTG<br>ATTCCAAACCTAAAAAGGATAAAAAGTCTCTCTGCTCTATACCGCCT<br>TTAATTTTGAAGACAAACAAACACGAAAAGAAGAAGGTGAGGGATCA<br>AGTGACTCAGGTAAGAGAGATCATCATGGAGAGCAGTGGCAAGGCAT<br>TGGATAACGGTCAGAAGCTCGAGGTTACGGTGGATGGAAATACTGGA<br>GGTGCTGCAGCCCTTTCTTTGCAGAGGACTGCTAGTATGAGAACTAA<br>AGGTCAGCAGATTGCACAGAGAATGTGGTGGCGCAATGTTAGGGTTG<br>TTCTCCTTTTGGATTTCGTTGTTTGCACAATACTGTTTGTTGTGTGG<br>CTCTGCATCTGTCGTGGTTTTAATGCGTTTCAGACTGATGGAGTACG<br>TCTCTTGGATAAACCTTTTCAAGATGTGTAGCTGTTTTCCTTTTAAG<br>CTCCAATCGGCCGCTTTTCAACTGCAATCTAGTGAATCGAATAATAT<br>GACTCTTAATATATACTGTAAATATAGATTTGTGGTGGCACGAAGAG<br>GCTTCGAATAATGTGACCTTCATGTTTTGGGTTCAGGAGGCCACTGT<br>ATTAGTATTGCTGTTGGTTAGCCAGTGTTTCAGAGTGTAATAGATAC<br>AAATGGGCTATTGTATGGGTCCTGGGAAGATATAGGAGAATTTGGTT<br>TGATTCTTGTACATTCTTCAGATGCCATATAACATTAAAGGGTGCAT<br>TCGTTTGATCAATGAAGGAAAACTGGTGTTGAAACACGGAAAAAAAA<br>AA |
| 195 | GCAAAACACTCCCCCCGCCCGCCCCCCCGCCCGCAACTCGCTCCGC<br>CCGGCTTTTTCTCTCGCTCGCTCGCTCGCGATTCTTTTGCTCTTC<br>CGCAAATCCCTAGTCGAGAGTTAGGTTTCGTAACAGTACACGGAAGA<br>TGTCGCCCTCTGATTCTTCACGGGAGGAATATGTGTACATGGCCAAG<br>TTAGCTGAACAGGCTGAGCGGTACGAGGAGATGGTGGATTTCATGGA<br>GAAAGTTGCCAAGACTGTGGACGTCGAGGAGCTAACCGTTGAGGAAC<br>GTAACCTTTGTCTGTGGCGTACAAGAATGTGATTGGGGCCAGGAGG<br>GCATCGTGGAGGATCATTTCTTCCATTGAGCAGAAGGAAGAGAGCAG<br>GGGTAACACCGATCATGTCTCGATCATTAAGGACTACAGGGGAAAGA<br>TCGAGTCCGAGCTCAGCAAGATCTGTGAAGGCATTCTCAGCCTTCTT<br>GAGTCGCATCTCATTCCTTCAGCCTCCTCTGCTGAGTCCAAGGTGTT<br>TTACCTTAAAATGAAAGGTGATTACCACAGGTATCTGGCAGAGTTTA<br>AGACTGCGACTGAAAGGAAAGAAGCTGCCGAGAGCACTTTATTGGCC |

TABLE 2-continued

Cell Signaling Gene Sequences

| SEQ ID NO | Sequence |
|---|---|
|  | TACAAATCTGCTCAGGATATTGCTGGGGCCGAACTGGCTTCTACTCA |
|  | CCCAATTAGGCTGGGACTTGCGCTGAACTTCTCTGTTTTCTACTATG |
|  | AAATACTTAACTCTCCTGATCGGGCTTGCGCTCTTGCAAAGCAGGCA |
|  | TTTGATGAGGCCATAGCTGAGTTGGATACGCTGGGCGAGGAATCATA |
|  | CAAGGACAGTACATTGATCATGCAACTTCTTCGAGATAACTTGACTC |
|  | TGTGGACTTCTGATCTTACGGATGAAGCTGGGGATGACATTAAGGAA |
|  | GCTTCGAAACTGGAGTCTGGAGAGGGGCAGCAATGATTTGCTAGGAT |
|  | GATGTCAGTACTTTAATGATATTTTGCACCGTCGTAGATGCCTTGTG |
|  | GTTTGTCACAGTGAAGATTATTTATGAACTGAGAGTGCTATAAGTTG |
|  | TTTCTCTAGTGTTCCTTGATGAGATTCGGGTTGGTCTTTAGAGTGTT |
|  | CTAATGGATATTACTATCTCAAATTGTCGGTTCCCGTGTGCGCTCTT |
|  | TCGTGCTGCCTAGTTTAAATTGCACGGACCCGTTGCATGTGATTATA |
|  | GATTTCTTTCTTTATCAGTTAATGCTAAGACAGTTCAAGGAAAAAAA |
|  | AAA |
| 196 | GATCGTCCATAGTGTGACCAGGATCAAGCGCTCTACATATCGTGCAA |
|  | CTATCACAATCAGGTCACAACAATGACGGAAGGATCAAACTACGACT |
|  | TCTTGTTCAAGGTTGTACTCATCGGAGACTCTGGCGTCGGGAAATCA |
|  | AACTTGCTCTCGCGGTTTACCAGGAATGAATTCAACCTGGACTCCAA |
|  | GTCTACCATCGGAGTCGAGTTCGCTACTAGATCTGTTCAAGTAGATT |
|  | CCAAGACAGTCAAAGCCCAGATCTGGGATACGGCGGGTCAGGAGCGA |
|  | TACCGTGCTATCACTTCAGCCTACTACCGAGGTGCTGTCGGGGCTCT |
|  | TCTCGTATACGACATTGCCAAGCACCCCACATACCAGAATGTGCACC |
|  | GGTGGTTGAAGGAGCTCCGTGATCACGCAGACTCCAACATTGTCATC |
|  | ATGCTTGTCGGGAACAAGAGCGATCTCAAGCATTTGCGAGCTGTCCC |
|  | TACAGACGAGGCGAAAGCCTTTGCTACCGAGAACAACTTGTCGTTCA |
|  | TCGAGACGTCGGCATTGGACGCTTCCAACGTCGAGGCCGCTTTTCAG |
|  | AATATCCTGTCTGATATCTACCACATCGTAGCAAAGAAGAACCTCGA |
|  | GAACTCGAGCGATGTGATTCAGCCGTTGGAAGGCCGCGGCATCGATA |
|  | TCGCAAAGTCGGAGGATGATGGCGGTGCCAAACAGGGCGGCAAATGC |
|  | TGCTAAAGCGAGTCTCACCCCAGGGTTCTTGATTTATGTGATCGGCT |
|  | CGATTTATGCGGCGTCACTTGATTGCGCGCAGCCTGTCGGATGTGAT |
|  | TCTCGTCTACATCCCGAATCCGACTATCTATCACGCTTTCCTTTCTT |
|  | TTGTCACCATTCTTGTATGACTTGTAAACAGTACGCAGATTCGATAT |
|  | CCTATTCGGCATAAAAAAAAAA |
| 197 | CTCAATGATCAGACAACAATCTCATCCAGCCGTTCTCACATCAAATC |
|  | TTGCGAACTCGGAAATTAGCGTTCAATATACATTGAGTAAAAGCAGA |
|  | TACTAGATGATACTTTAAACGCTCGGTCCCGAGTTCGATCACTGTCG |
|  | GGTCACGCAACCAACTGCCAGAAGAATGCAGAGGCCGTCGAAGACGT |
|  | CTGTGGGCTATGCGATTCCGGACGAGGTTTTGAAGTGCGTGATGGGG |
|  | TACCTGGAGGAGCCGTGCGATCGCAGTGCGGTTTCCCTGGTCTGCAA |
|  | GAGGTGGAACCGTGTGGATGCGCTCACTCGCAAGCACGTTACCATTG |
|  | CGTTCTGTTACACCATAAGCCCCTCGGATCTCGGTGCACGGTTCCCC |
|  | GAGCTTGAGTCGCTGAAATTGAAGGGAAAGCCCAGGGCTTCCATGTT |
|  | TAATTTGATTCCCCAGGACTGGGGCGGATACGCGGAGCCGTGGATTA |
|  | ATGAGATTTCCCAGACGTTGCTCTGCTTAAAGGCTCTTCATTTGCGC |
|  | AGAATGATCGTTACGGATGAGGATCTCAGGGCTTTGGCTCGCGCCCG |
|  | CGGCCACATTCTGCAGGTTCTTAAACTGGAGAAGTGCTCGGGGTTTT |
|  | CGACTCTCGGGCTTCTCGAAGTCGCACGGTCCTGCAGATCTCTTAGG |
|  | GTCTTGTTTTTAGAGGAAAGTACTATTGAAGATGAAGGTGGAGAATG |
|  | GTTACATGAGCTTGCTCTTCATAATTCTTCATTGGAAGTTTTGAACT |
|  | TCTACATGACAGGTTTGGAAAATGTTAATGTTAATGACCTTGAGATG |
|  | ATAGCAACAAACTGTCGATCTCTGACCTCATTCAAGATAAGTGAATG |
|  | TGATATTCTGGATTTAAGAAATGTATTCAAGAAGGCCACAGCATTGG |
|  | AAGAGTTTGGCGGTGGGTCATTTAGTAGCAGTGAAGAGCAGGCTGTA |
|  | GAACCAAATATTTATGAAATGGTTAAATTCCCTACAAATTTGATGTC |
|  | ATTGTCAGGACTGAATTACATGAGTGAGACTGAATTACCAGTTGTAT |
|  | TTCCACGAGCATCTTCACTAAAGAAACTGGATTTGCAGTATACACTT |
|  | TTGAGCACAGAAAACTATTGCCAGTTGTTACAGTCGTGCATTAATAT |
|  | TGAAATTCTTGAGGTTACGAATGCGATTGGAGATAGAGGGTTAGAAG |
|  | TAGCAGCTGAGAATTGTAAAAAATTAAGGCGACTTAGAGTGGAGCGT |
|  | GGGGAAGATGAAGCTGGTTTGGAGGGTCAGCAAAACTTTGTTTCTCA |
|  | CAAAGGGCTTTCAGTTATAGCTCAAGGCTGTCCCAATCTAGAGTACA |
|  | TTGCTGTGTATGTTTCAGATATGACTAACTCAGCCTTAGAATCTGTT |
|  | GGTAAATTTTGCAAAAATCTGAGGGATTTTCGGCTAGTCTTGCTAGA |
|  | CAAGAAGAACAAGTGACTGACCTCCCACTAGACAATGGTGTCATGG |
|  | CTCTGCTTGGGTGCCAAAAGTTGAAGAGGTTTGGATTTTACCTTA |
|  | AGGCCTGGAGGATTGACGGACATAGGCCTTGGTTACATTGGAAAGTT |
|  | TAGTAGCAATGTGAGGTGGATGCTTCTGGGTTATGTCGGAGAGACTG |
|  | ACTTTGGGCTTCTTGAGTTCTCGAAGGGATGCCCAAATTTGGAGAAA |
|  | CTTGAATTAAGGGGTTGTTGCTTCAGCGAATATGCATTATCTGTGGC |
|  | AGCGCTTAGCTTGAGGTCTCTAAAATATATCTGGGTTCAGGGCTACA |

TABLE 2-continued

Cell Signaling Gene Sequences

| SEQ ID NO | Sequence |
|---|---|
| | ATGCAACGCCATCTGGATTTGATCTTCTAGCTATGGAGCGCCCTTTC<br>TGGAACATAGAGTTTACTCCAGCTTCTCAAGTGACAGTGGATGGTTT<br>TAATTTGGAAGAAGAAATTACAGAGAAGCCAGCACAGATATTGGCTT<br>ATTATTCGCTTGCAGGAAGACGAACAGACCATCCAGATTCAGTAATT<br>CCTTTAAGCTTATCCTCATGGAATCGTCAGCTCCAGCATGTATATGA<br>ATATTCTCTTTTCCATGCATATGAATATTAAGTTGCTGTGTTATAGT<br>TATTATTGGTGTGGATCTATGTACATTTTAACCTTCTAAGGAGTGGA<br>GCGTATATAATGGTTATGGTGTCAGTTATACTTCCTCGGCATGCCTT<br>TTGAAAACTATAAAGGCAAGAAGAATTAGCCACGCATGGCCCTTGTG<br>CCTGTCTTCCGCCTGCAAGCATGGATTTTATGCTGACTGCTTCAACG<br>TTATATGGAGATGGATTCCTTAATCTGTCGCATTTAAGAGGAAAGCC<br>CTGCTTTGTCAAATCTTATGCCTGCTGTCTGTATATTACGCAGAGGA<br>TTTGTCCATCTATAACATGATCGTCGATCGTCACTACTTTACCACAG<br>AAATGAATGCAGGCAACTCCTTGAGGAGCTTCTAGATCTATTCTTTC<br>TTGAGGCTATCACATTCTAGAAGAAAATGGTGGCTTACTCGAAGCTG<br>AGGACTCAGAATGTATTTATGCTTGAGATTACATCATATTAACATGT<br>AAGTTTATTGGAATCTGAAAATTCCTGATGTATCCATTTGTGGGACT<br>TTCGGTCAGTACAAAAGACTCAACATATGCCAAGGATTCCTGATTT<br>GATTTGAGGTAGAGAAGGGTTCGGAGTTCTCATTTGAGATTATGGCA<br>AGTTAGAAAATCAGAAGGATGATTAAAAGCTGAAGATTCCTTGCATT<br>TAGAATTGGGATCAGACTTCTAAAGCTAAGCCTGGTCTATCTGTATT<br>TCTCATTTCACCATTGCGAGGTTTGCATCTTTAAATCATGGATTTCT<br>TTCAATAATTTGTAGCTTTCTCGTGCTAACAAGACAAATTTCTGCCT<br>AGTGTGGAGAGTTCAAAGCCTACAGTTTGATTTCTTTTTCTTTTCGC<br>TAAAGAAATTGATTCGCATAAAGACAAAGGACATACTGCTACTATG<br>TTTGTAGAATCCACAATTATTTGTACATATTCAATGTGTTTTATATA<br>GCTTAATACAAGTAGTCTGTACGTATCCTGTAAAAAAAAA |

TABLE 3

Cell Signaling Protein Sequences

| SEQ ID NO | Sequence |
|---|---|
| 198 | MEREREQQVYQARLAEQAERYDEMVESMKQVAKLDVELTVEERNVLS<br>VGYKNVIGARRASWRILSSIEQKEGTKGNEQNVKRIKDYRQRVEDEL<br>AKICSDILSVIDKHLIPSSSGESTVFYYKMKGDYCRYLAEFKAGDD<br>RKEAADQSLKAYEASSTASTDLAPTHPIRLGLALNFSVFYYEIMNS<br>PERACHLAKQAFDEAIAELDSLNEDSYKDSTLIMQLLRDNLTLWTTD<br>LPEEGGEQSKVDEPAAES |
| 199 | MSPSDSSREEYVYMAKLAEQAERYEEMVDFMEKVAKTVDVEELTVEE<br>RNLLSVAYKNVIGARRASWRIISSIEQKEESRGNTDHVSIIKDYRGK<br>IESELSKICEGILSLLESHLIPSASSAESKVFYLKMKGDYHRYLAEF<br>KTATERKEAAESTLLAYKSAQDIAGAELASTHPIRLGLALNFSVFYY<br>EILNSPDRACALAKQAFDEAIAELDTLGEESYKDSTLIMQLLRDNLT<br>LWTSDLTDEAGDDIKEASKLESGEGQQ |
| 200 | MAAADSSREENVYMAKLAEQAERYEEMVEFMEKVAKTVDVEELTVEE<br>RNLLSVAYKNVIGARRASWRIISSIEQKEESRGNEDHWIIKEYRGKI<br>ETELSKICDGILNLLESHLVPSASSAESKVFYLKMKGDYHRYLAEFK<br>AGTERKEAAESTLLAYKSAQDIALAELAPTHPIRLGLALNFSVFYYE<br>ILNSPDRACSLAKQAFDEAISELDTLGEESYKDSTLIMQLLRDNLTL<br>WTSDVTDEAGDEIKESSKRESGEGQPPQ |
| 201 | MASTKERDGYVYVAKLAEQAERYDEMVEAMKNVAKLDVELTVEERNL<br>LSVGYKNVIGARRASWRILSSIEQKEDSKGNEHNVKKIKEFRQKVEA<br>ELANICGDVMKVIDEHLIPSCAGGESTVFFYKMKGDYYRYLAEFKAG<br>DDRKEAADQSMKAYELASTTAEADLSPTHPIRLGLALNFSVFYYEIM<br>NSPERACHLAKQAFDEAISELDTLSEESYKDSTLIMQLLRDNLTLWT<br>SDIPEDGAEDAQKLDNAAKAAGGEDAE |
| 202 | MAEHRSYGNVNLKTFDAHVPEIKFTKLFIDGEFVDSVKGRTFETKDP<br>RNGQWARVAEGDEEDVELAVIAARRAFDHGPWPRMPGYQRGRIMSKF<br>ADLIEENIDELMLDTIDAGKLFSVGKARDIPNAAMLLRYYAGAVDKI<br>HGEVLKMSRELHGYTLREPVGVIGHIIPWNFPTGVFFMKVAPTLAAG<br>CTMIVKPAEQTPLSALFYAHLAKKAGVPDGVINWTGFGPTAGAAISS<br>HMDIDMVSFTGSTKVGHMVMQAAATSNLKQVSLELGGKSPLIVFDDV<br>DLDTATNLALTGILYNKGEVCVAGSRVYVQEAIYEEFEKKLVAKAKA<br>WPVGDPFDPNVRQGPQVDKKQFEKILSYIEHGKREGATLLIGGERLG<br>TEGYYIQPTIFTDVNEDNVIVKDEIFGPVMSLMKFKTMEEVIKRAND<br>TRYGLAAGILTKNIDLANTVSRSIRAGMIWINCYLAVDNDCPYGGYK<br>MSGFGKDLGLDALHKYLHVKSIVTPIYNSPWL |
| 203 | MAENQSDANGSLKTYDEHVPDIKFTKLFINGEFVDSVKGRTFETIDP<br>RNGEVTARVAEGDKEDVDLAVKAARQAFDHGPWPRMPGYQRGRIMSK<br>FADLIEENIDELAALDTIDAGKIFSMGKAVDIPHAATCLRYYAGAAD<br>KIHGEVLKMSRELHGYTLLEPVGWHIIPWNFPTSMFFMKVAPALAA<br>GCTMIVKPAEQTPLSALYYAHLAKKAGVPNGVINVVTGFGPTAGAAI<br>TSHMDIDMVNFTGSTKVGRIVMQTAATSNLKQVSLELGGKSPIMIFD<br>DADLDTDLALIGIVHNKGEICVAGSRVYVQEGIYEEFEKKLVAKA<br>KAWPVGDPFDPKVQQGPQVDKKQFEKILSYIEHGKREGATLLTGGER<br>LGTKGYYVQPTIFTNVKEDNVIVKDEIFGPVMSLMKFKTVEEAIKRA<br>NDTRYGLAAGIVTKNIDVANTVSRSIVIWINCYFAFDNDCPCGGYKT<br>SGFGRDLGLDALHKCLHVKSIVTPLYNSPWL |
| 204 | MREREMAENQSNANGSLKTYDAHVPEIKFTKLFINGKFVDSVKGRTL<br>ETIDPRNGQATARVAEGDKEDVDLAVKAARQAFDHGPWPRMPGYQRG<br>RIMSKFADLIEENIDELAALDTIDAGKLFSVGKAQDIPHAATMLRYY<br>AGAADKIHGEVLKMSRELHGYTLREPVGVIAHIIPWNFPTAVFFMKV<br>APALAAGCTMIVKPAEQTPLSALFYAHLAKKAGIPDGVINIVTGFGR<br>TAGAAISNHMDIDMVSFTGSTEVGRIVMQAAATSNLKQVSLELGGKS<br>PLIIFDDVDLDTATDLALTGILHNKGEICVAGSRVYVQEGIYEEFKN<br>KLVAKAKAWPVGDPFDPNVRHGPQVDKKQFEKILAYIEHGKREGATL<br>LTGGERLGTEGYYIQPTIFTNVEDNMIVKDEIFGPIMSLMKFKTTE<br>EVIKRANDTRYGLAAGVLTKNIDMANTVSRSIRAGTIWINCYFAFDN<br>DCPLGGYKMSGFGRDFGLDALHKYLQVKSVVTPIYKSPWL |
| 205 | MASRRRMLLKVIILGDSGVGKTSLMNQYVNRKFSNQYKATIGADFLT<br>KEVQFEDRLFTLQIWDTAGQERFQSLGVAFYRGADCCVLVYDVNVMK |

TABLE 3-continued

Cell Signaling Protein Sequences

SEQ
ID
NO Sequence

205 SFDNLNNWREEFLLQASPSDPENPPFWLGNKIDVDGGNSRWSEKKAK
AWCASKGNIPYFETSAKEGFNVEAAFECIAKNALKNEPEEEIYLPDT
IDVTGGGRQQRSTGCEC

206 MAVPENLGRDQYVYLAKLAEQAERYEEMVEFMHKLWGWTPAAELTVE
ERNLLSVAYKNVIGSLRAAWRIVSSIEQKEEGRKNEDHWLVKEYRSK
VENELSDVCASILRLLDTNLVPSAAASESKVFYLKMKGDYHRYLAEF
KVGDERKAAAEDTMLAYKAAQDIAQADLASTHPIRLGLALNFSVFYY
EILNQSDKACSMAKQAFEEAIAELDTLGEESYKDSTLIMQLLRDNFT
LWTSDVQDQLDEP

207 MATAPSAREENVYMAKLAEQAERYEEMVEFMEKVAAAAAAADAEELT
IEERNLLSVAYKNVIGARRASWRIIS-
SIEQKEESRGNEDHVAAIRDYRS
KIESELSGICAGILKLLDSRLIPAAAS-
GDSKVFYLKMKGDYHRYLAEFK
TGAERKEAAESTLTAYKAAQDIAN-
TELAPTHPIRLGLALNFSVFYYEIL
NSPDRACSLAKQAFDEAIAELDTL-
GEESYKDSTLIMQLLRDNLTLWTSD
MQEDGADEIKEAPKADEQQ

208 MAAAAPPPSSPREEYVYMAKLAEQAERYEEMVEFMEKVSAAAADAEE
LTVEERNLLSVAYKNVIGARRASWRIISSIEQKEESRGNEDHVAAIR
DYRAKIEAELSKICDGILGLLPIPAASVGDSKVFYLKMKGDYHR
YLAEFKTGTERKEAAESTLTAYKMQDIANSELAPTHPIRLGLALNFS
VFYYEILNSPDRACGLAKQAFDEAIAELDTLGEESYKDSTLIMQLLR
DNLTLWTSDMQDDGVDEIKETAKADEQ

209 MKKGGLNPILNLKLSLPPPDEDSIAKFLTQSGTFVDGDLLVNRDGVR
VVQQTEVEVPPLIKPTDNQLSLADIDTKIGKGNGGIVQLVQHKWTG
QFFALKVIQMKVEESARKQIAQELKINQSSQCPYVVVCYQSFYDNGT
VSIILEYMDGGSLADFLRKVKTIPEPNLAVICKQVLKGLLYLHHEKH
IIHRDLKPSNLLINHRGEVKITDFGVSAIMASTSGQANTFVGTYNYM
SPERIIGNNYGYKSDIWSLGLVLLECATGKFPYTPPDQQEGWTNFYE
LMEAIVDHPPPSAASDQFSSEFCSFISACVQQDPKKRWSANELMGHP
FISMYEDLNVDLASYFTNAGSPLATF

210 MEDDERGEEYLFKIVLIGDSGVGKSNLLSRFALDEFDINTKATIGVE
FQTQVVEIDGKEVKAQIWDTAGQERFRAVTSAYYRGAVGALIVYDIT
RRTTFESVKRWLDELDTHCDTAVARMLVGNKCDLNNIREVSTEEGKA
LAEAEGLFFMETSALDSTNVQISFEIVIREIYKNISRKVLNSDSYKA
ELSVNRVTLAKNGADSSGRSFYSCCAR

211 MSSSDEEGGEEYLFKIVIIGDSAVGKSNLLSRYARNEFNPHSKATIG
VEFQTQSMDIDGKEVKAQIWDTAGQERFRAVTSAYYRGAVGALVVDI
TRRSTFDSVSRWLDELKTHSDTTVARMLVGNKCDLESIRDVTVEEGK
SLAESEGLFFMETSALDATNVKTAPFEIVIKEIYNNVSRKVLNSDAYK
AELSVNRVTLAGNGADSGKRSQSFSCCSR

212 MALVPSDPINNGQSLPLIAEVNMSSDSSSAAAVVRATVVQASTVFYD
TPATLDKAERLLAEAASYGSQLVVFPEAFVGGYPRGSTFGVSIGNRT
AKGKEEFRKYHASAIDVPGPEVDRLAAMAGKYKVFLVMGVIERDGYT
LYCTILFFDPQGHYLGKHRKVMPTALERVIWGFGDGSTIPYPGTPIG
KIGAAICWENRMPLLRTAMYAKGVEIYCAPTADARDIWQASMTHIAL
EGGCFVLSANQFCRRKDYPPPPEYVFAGTDDDLNPDSVVCAGGSVII
SPSGNVLAGPNYDGEALISADLDLGEIARAKFDFDWGHYSRPEVLSL
IVRDHPSNPVTFASTSGKPEGPYK

213 MDPSKSRDSAESTRVIQFPNDVLERILSLIDSHRDRNAVSLVSKAWY
NAERWTRRHVFIGNCYAVSPQIVARRFPNIRSVMLKGKPRFSDFNLV
PPNWGADVHGWLAVFADQYPQLEELRLKRMTVTDESLKFLARKFHNF
RVLSLLSCDGFSTDGLEAIATDCRHLTELDIQENGIDDISGNWLSCF
PENFTSMEVLNFASLSSDVNFDALERLVSQCKSLKILKVNKSITLEQ
LQRLLVRAPQLTELGTGSFLQELTAHQSEELERAPIGCKYLHALSGL
WEATTLYLPVLYPACTNLTFLNLSYAALQSEELAKLVAHCPRLQRLW
VLDTVEDVGLEAVASSCPLLEELRVFPADPYDQDINRGVTESGFLAV
SLGCRKLHWLYFCRQMTNAAVARIVQNCPGFTHFRLCIMKPGQPDYL
TNEPMDEGFGAVVKTCTNLRRLGVSGLLTDLTFEYIGRYAKNLETLS
VAFAGGSDLGMKSILVGCPKLRKLEIRDCPFGNEALLSGLEKYESMR
SLWMSACKVTLHGCKTLATQRPRLNVEVMKDEEIDDGQSYKVYYRT
VAGPRTDAPSFVHTL

214 MESCNCVEPQWPADELLMKYQYLSDFFIALAYFSIPLELIYFVKKSA
VFPYRWVLVQFGAFIVLCGATHLINLWTFAIHSRTVAWMTIAKVLTA
AVSCITALMLVHIIPDLLSVKTRELFLKNKAAELDREMGLIRTQEET
GRHVRMLTHEIRSTLDRHTILKTTLIELGRTLGLEECALWMPTRSGL
ELQLSYTLRQQQNPVGYTVPIHLPVINRVFSSNRALKISPNSPVARI
RPLAGKYIPGEVVAVRVPLLHLSNFQINDWPELSTKRYALMVLMLPS
DSARQWHVHELELVEVVADQVAVALSHAAILEESMRARDLLMEQNVA
LDLARREAETAIRARNDFLAVMNHEMRTPMHAIIALSSLLQETELTP
EQRLMVETIMKSSNLLATLINDVLDLSRLEDGSFQLNIATFNLHAVF
REVLNLIKPVASVKKLLITLNLAPDLPEYAVGDEKRLMQVILNVVGN
AVKFSKEGGISITAFVAKAEYLREARTPEFLPLPSDNHFYLRVQVRD
SGSGVNPQDIPKLFTKFAHNQSLATRNSGGSGLGLAICKRFVTLMDG
HIWIESEGIGKGCTATFIVRLGIPEKLNESKFPVLPRGSSNHVLANF
SGLKVLVMDDNGVGRAATKGLLLHLGCDVTTVSSGDELLHAVSQEHK
VVLMDICTPGIDSYEVAVQIHRLYSQHHERPLLVAITGSTDKVTKEN
CMRVGMDGVIQKPVSLDKMRNVLSELLECGHQMSSLARV

215 MASRRRMLLKVIILGDSGVGKTSLMNQYVNRKFSNQYKATIGADFLT
KEVQFGDRLFTLQIWDTAGQERFQSLGVAFYRGADCCVLVYDVNVMK
SFDNLNHWREEFLIQASPSDPENPPFVVLGNKIDIDGNSRWSEKKA
KAWCASKGNISYFETSAKEGFNVEAAFQCIAKNALKNEPEEELYLPD
TIDVAGGGQQQRSSGCEC

216 MAGGGYRADDDYDYLFKVVLIGDSGVGKSNLLSRFTRNEFSLESKSTI
GVEFATRSIRVDDKKVVKAQIWDTAGQERYRAITSAYYRGAVGALLVY
DVTRHVTFENVERWLKELRDHTDSNIVIMLVGNKADLRHLRAVSTED
AKAFAERENTYFMETSALESMNVENSFTEVLTQIYHVVSRKALDVGE
DPAAPPKGQTISVGSKDDVSAVKKVGCCSA

217 MVDSFDEECDYLFKAVLTGDSAVGKSNLLSRFARKEFQLDSKPTIGV
EFAYRNVKVADKLIKAQIWDTAGQERFRAITSSYYRGALGALLVYDI
TRRVTFENVKKWLRELRDFGNPDMVVVLVGNKSDLGSSREVDLEEGK
DFAEAEENLCFMETSALENLNVEEAFLEMITRIHEITSQKSLEAKNNE
ITSSLHGPKQVIQIDEVTATKKPYCCSS

218 MAGYKADEEYDYLFKLVLIGDSGVGKSNLLSRFTRNEFNLESKSTIG
VEFATKSLSIDGKVVKAQIWDTAGQERYRAITSAYYRGAVGALLVYD
VTRRATFENVARWLRELRDHTDPNIVVMLIGNKSDLRHLVAVPLEDG
DPPFAEMSHYYFMQTSALDATNVEAAFAEVLSQIYRIVSKRAVEAGDN
PSVSCVPGQGQTINVKEEGSVFKRIGCCSS

219 MASGGGYGDGNQKIDYVFKVVLIGDSAVGKSQILSRFARNEFSLDSK
ATIGVEFQTRTLVIQHKSVKAQIWDTAGQERYRAVTSAYYRGAVGAM
LVVDITRRQSFDHIPRWLEELRSHADKNIVIILVGNKTDLENQRAVP
TEDAKEFAQKEGLFFLETSALDSTNVESAFLYVLTEIFNIVNKKSLV
AGESQTNGNPASLAGKKIIIPGPAQEIPAKNKMCCGT

220 MADAAAQNGQFSDFPAVPTHGGQFIQYNIFGNHFEITAKYRPPIMPI
RGRAYGIVCSVLNSETNEMVAIKKIANAFDNHMDAKRTLREIKLLRH
LDHENVIGIRDVIPPPLRREFTDVYIAMELMDTDLHQIIRSNQGLSE
EHCQYFLYQILRGLKYIHSANVIHRDLKPSNLLLNANCDLKIIDFGL
ARPTAENEFMTEYVVTRWYRAPELLLNSSDYTAAIDVWSVGCIFMEL
MNRKPLFPGRDHVHQMRLLVELLGTPADADLGFVRNEDARRYIRQLP
QHPRQPLASVFPHVHPLAIDLVEKMLTFDPTKRITVEEALAHPYLTR
LHDIADEPVCRQPFSFEFEQQPLGEEEQMKDMIYQEAIALNPEFA

221 MATLVEPPNGVHSEGKHYYSMWQTLFEIDTKYVPIKPIGRGAYGIVC
SSVNRETNEKVAIKKIHNAFENRVDALRTLREIKLLRHLRHENVIGL
KDVMMPIQRKSFKDVYLVYELMDTDLHQIIKSSQTLTNDHCQYFLFQ
LLRGLKLYLHSANILHRDLKPGNLLINANCDLKICDFGLARASNGKQ
FMTEYVVTRWYRAPELLLCCDNYGTSIDVWSVGCIFAELLGRKPLFP
GTECLNQLKLIINVLGSQREEDIEFIDNPKAKKFIKSVPYSPGTPLS
RLYPNAHPLAIDLLQKMLIFDPSKRIGVTEALQHPYMSPLYDPNTNP
PAQVPIDLDVNEDLEEEMIREMMWKEMLHYHPEVAVGNLEVYS

222 MNYFPDEVIDHVFDFVTSNRDRNVISLVCKSWYRIERLSRQRVFIGN
CYAISPERLIARFPGVRSLTLKGKPHFADFNLVPPDWGGFVYPWIDA
LARSKVNLEELRLKRMVVTDDGLELISRSFVNFKSLVLVSCEGFTTD
GLAAIAANCRFLRELDLQENEVEHRGQWLNCFPDSCTSLVSLNFAC
LKGDINLAALERLVARSPYLKSLRLSRAVPLDTLQKILVRAPQLVDL
GVGSFVHDPDSETYNKLVTAIEKCKSMRSLSGFLEVSAYCLPAIYPI
CSGLTSLNLSYAPGIPGSELTKLIRHCRKLQRLWILDCIGDKGLGVV
ASSCKELQELRVFPSDPYGVGNAAVTEEGLVAISRGCPKLNSLLYFC

TABLE 3-continued

Cell Signaling Protein Sequences

| SEQ ID NO | Sequence |
|---|---|
| | QQMTNAALKIVAQNCPNFIRFRLCILEPTKPDSSTNQPLDEGFGAIV QSCKGVRRLSLSGLLTDQVFNYIGTFAEQLEMLSIAFAGDNDKGMLY VLNGCKKIRKLEIRDCPFGNIALLTDVGKYETMRSLWMSSCDITLGG CKTLAKKMPRLNVEIINENNEMEDCIDDEQKVERMYLYRTLVGPRKD APEHVWTL |
| 223 | MKRDHRDACSGGYGGGGGGEASGASKGEPPSSSSTHSLPGSGKAKMV MWGEDDQDPSGGGGGGMDELLAVLGYKVRSSDMAEVAQKLEQLEMVM GSAQEDGISHLSYDAVHYNPSDLSSWVQSMLFELNPPPPPQQVADAV LAAAESSSTIAQHHRSHLGSRSQTQTRTLSQTSAPTQTQSQVIFNDD SEYDLRAIPGVAAFPQGDSDFESAARKKMKTLNGGSNSLSSSSSSSA AGAAPSESTRPVVLVDTQETGVRLVHTLMACAEAVQQENLKLADALV KHIGLLAASQNGAMRKVATYFAEALARRIYRIYPNDGSLDSSCNDIL QMHFYETCPYLKFAHFTANQAILEAFATASRVHVIDFGLKQGMQWPA LMQALALRPGGPPAFRLTGIGPPQPNNTDALQQVGWKLAQLADTIGV EFEFRGFVANSLADLEPAMLDIRPPEVETVAVNSVFELHPLLARPGA IDKVLSSIKAMRPKIVTMVEQEANHNGPGFVDRFTEALHYYSSLFDS LEGSGVAPPNQDLVMSEVYLGRQICNVYACEGPDRVERHETLVQWQA RMGSAGFDPVHLGSNAFKQASMLLALFAGGEGYRVEENDGCLMLGWH TRPLIATSAWQLAAATQ |
| 224 | MSKVLRFTGGEDFYSGRSIYQSPKEVNLFLSLGNHVDVYFPPSKRSR ISAPFVFSEDLFEQKRQDTIEVLPDECLFEIFRRLPGGQERSACACV SKRWLNLLSNICPNERSSGKSQNNLDPTCGGEEVSSEDDGFLSRSLE GKKATDIRLAAIAVGTADRGGLGKLSIRGSKLSHVTSLGLGAIARSC PSLKALSLWHLPSVGDEGLLEVANGCHQLEKLDLCQCPNITNKFLVA VARNCPNLTDISIESCSSIGNEGLAAVGQFCQNLKSISIKNCPSVGD QGIVGLISRAGSALTKFKLQALNITDVSLAVIGHYATAVTDLTLASL HNVTERGFWVMGNGHGLQRLRSLIVTACRGATDLGLESLGKGCPNLK QLCIRSSAFLSDGGLVSFMKSARSLESLQLEECHRITLSGLYGLVVG CGDKLKSLALTNCWGFKDFDFGSPQVSPCKSLRSFSVRNCPGFGDAC LVALGKICPHLQQVELSGLTGITDEGLLRLLECCEAGLVKVNLSGCI NLTDQVVSAMAKLHGRTLEVLILDGCTKVSDLGLLAIAENCQLLSDL DVSKCAISDFGLMALARSSQLSLQVLSVSGCSLVSDKCLPALKKVGR TLLGLNLQHCTAISTRSVDLLLEELWRCDILA |
| 225 | MGESRRGEMDGTTRGGSNADMYLPNYKLGKTLGIGSFGKVKIAEHVL TGHKVAIKILNRRKIKNMEMEEKVRREIKILRLFMHPHIIRLYEVIE TPTDIVMEWKSGELFDYIVEKGRLQENEARNFFQQIISGVEYCHRNM WHRDLKPENLLLDSKWNVKIADFGLSNIMRDGHFLKTSCGSPNYAAP EVISGKLYAGPEVDVWSCGVILYALLCGTLPFDDENIPNLFKKIKGG MYTLPSHLSAGSKDLIPRMLIVNPMKRITIPEIRQHPWFQAHLPRYL AVPPPDTMQQAKKIDEEILQEWNMGFERNQLVESLRNRIQNEATVAY YLLLDNRFRPSNGYLGDEFQETMECTFNRGNPGELTIPTVGPRYPLP GYMDYQGVNSKPGYYGAEKKWALGLQSRAHPREIMTEVLKALRELNV CWKKIGHYNMKCMWNPCVPSHESMVSNPVQSNYFGDESTIIENDGAT KSRNWKFEVQLYKTTEEKYLLDLQRVQGPQFLFLDLCAAFLAQLRVL |
| 226 | MAGYRAEDDYDYLFKIVLIGDSGVGKSNLLSRFTRNEFSLESKSTIG VEFATRSLNVDGKVIKAQIWDTAGQERYRAITSAYYRGAVGALLVYD VTRHSTFENVERWLRELRDHTDPNIWMLVGNKSDLRHLLAVSTEDGK SFAEREALVFMETSALEATNVENAFAEVLTQIYNIVSKKALETSEQA NGSAVPSQGEKIDVGKDVSAVKRGGCCSS |
| 227 | MDSSRESLVYVAKLAEQAERYEEMVDEMKKVAKLNVALTVEERNLLS VGYKNVIGARRASWRILTSIEQKEDARGNEISVRIKEYRKKVESEL SSICSDIMVILDEHVIPSASDGESKVFYYKMKGDYYRYLAEFKSDDE KKEVAEQSMKAYEMATSIAESDLPYTHPIRLGLALNFSVFYYEILNS AERACHIAKQAFDDAIAELDNLNEESYKDSTLIMQLLRDNLTLWTSD ITEEGEDAQRINGSAKVGMEEGE |
| 228 | MEDRNVKRPDSPGLSDIVLTCVMPYIDDPKDRDAISLVCRRWYEIDA LTRKHVTIALCYTTSPERLRRRFRHLESLKLKGKPRAAMFNLIPENW GGYVTPWVTEIAQSFDCLKSLHFRRMIVEDSNLEVLATSRGRVLQVL KLDKCSGFSTDGLLHVGRLCKTLRTFFLEESTIIEKDGAWLHELAMN NTVLETLNFYMTELSSFSVQDLQIIARNCRSLTSVKISDCEILDLVG FFQDAAALEEFGGGLFNEEPERYAALSFPARLCRLGLTYISENEMPI VFPIASRLRMLDLLYAFLSTDDLCLLIQQCPILEVLETRNVIGDRGL EVLAHSCKRLKRLRIERGADEQGMGDEGGLVSQRGLMDLARGCELEL YLAVYVSDITNSSLECIGTYSKNLCDFRLVLLDREEKITDLPLDNGV RAILRGCEKLRRFALYLRPGGLTDVGLGYIGQYSQNIRWMLLGYVGE SDEGLREFSRGCPSLQKLEMRGCCFSEQALADAVMRLTSLRYVWVQG YRGSDTGRDILAMVRPFWNIELIPARRIAVANQNGENVLNEDPAHIL AYYSLAGPRNDCPDSVIPLAPARLLTL |
| 229 | MANRVDHEYDYLFKIVLIGDSGVGKSNILSRFTRNEFCLESKSTIGV EFATRTLQVEGKTVKAQIWDTAGQERYRAITSAYYRGAVGALLVYDI TKRQTFDNVQRWLRELRDHADSNIVIMMAGNKSDLNHLRAVPGDDGQ ALAEKEGLSFLETSALDATNIEKAFQTILTEIYHIISKKALAAQEAA ATTLPGQGTTINVADATGNANKRGCCST |
| 230 | MESFPVINMENLNGEKRAITMDKIKDACENWGFFELVNHGIPPEFMD TIESMTKGHYKKCMEQRFGELVASKGLECVQTEVHDLDWESTFHLKH LPVSNISQIPDLDDDYRRVMKEFALKLEKLAEELMDLLCENLGLEKG YLKKAFYGSQGPNFGTKVSNYPPCPKPDLIKGLRAHTDAGGIILLFQ DDKVSGLQLLKDGQWVDVPPMRHSIWNLGDQIEVITNGKYKSILHRW AQTDGNRMSIASFYNPGSDAVIYPAPALVESEAEEASKAVYPKFVFE DYMKLYAALKFQAKEPRFQAMKAMESSPSLGPIATA |
| 231 | MESFPVINMENLNGEKRAITMDKIKDACENWGFFELVNHGIPPEFMD WERMTKGHYRKCMDQRFRELVASKGLENVQTEVHDLDWESTFHLKHL PLSNISQVPDLEDDYRKVMKEFAVKLEKLAEELMDLLCENLGLEKGY LKKAFHGSNGPNFGTKVSNYPPCPKPELIKGLRAHTDAGGVILLFQD DKVSGLQLLKDGQWVDVPPMRHSIWNLGDQIEVITNGKYKSVLHRWA QTDGNRMSIASFYNPGSDAAIYPAPALMESKAEEASKAAYPKFVFED YMKLYAALKFQAKEPRFQAMKVMESSPNLEPIA |
| 232 | MSGGSDLPEEILIQILLKLPVKSLVRFRCVSKSWDSLITHPSFVSLH LRHAMAGHDRSVILLRHYSLTQRKERNTLYLDGESFLEHQELEFPLK THDTYYLAGSCNGLLCFSDYIINNLQVILWNPSLRKCVQLPIPRFID TDLTHTYVLGFGFDTRRVDYKWRLIYILGKNWSVIVPPEVEIYELKT NAWRGIQTAVPYVIPESSSQAFVNGAIHWIGYNPADRRLKVASSPRS IWLFDMQDEVFGEMELPKGGDYANRLNLSLAVHQDLICLLHCHPMEE DGHQLYGVCWVMVMKEYGAADSWTKLFTINISEHGGIGRILGFRKKG DALLVTHNDELVSYDLRGQRISRLGLYGVARSFEVIPYMDCLILV |
| 233 | MGCSSSLPDRASGRLGGLNSENGAVNDAKNLRVKLVLLGDSGVGKSC IVLRFVRGQFDPTSKVTIGASFLSQTIALQDSTTVKFEIWDTAGQER YAALAPLYYRGAAVAVVVYDITSPESFQKAQYVWKELQKHGSPDMVM ALVGNKADLQENREVWQDGIDYAEKNGMFFIETSAKTADNINQLFEE IAKRLPRPTPS |
| 234 | MDGGAPQPADWMSEAAPAQQQQQQPQQAQPQGIENIPATLSHGGRFI QYNIFGNIFEVTAKYKPPIMPIGKGAYGICVSALNSETNEHVAIKKI ANAFDNKIDAKRTLREIKLLRHMDHENWAIRDIIPPPQREVFNDVYI AYELMDTDLHQIIRSNQALSEEHCQYFLYQILRGLKYIHSANVLHRD LKPSNLLLNANCDLKICDFGLARVTSETDFMTEYVTRWYRAPELLLN SSDYTAAIDVWSVGCIFMELMDRKPLFPGRDHVQQLRLLMELIGTPS EAELGFLNENAKKYIRQLPYRRQSFTEKFPHVHPLAIDLVEKMLTF DPRLRLTVEEALAHPYLNSLHDISDEPTCMNPFNFDFEQHALTEEQM RELIYREALAFNPEYLQ |
| 235 | MESSSSGGASAEHSVRGIPTHGGRYVQYNVYGNLFEVSRKWPPIRPI GRGAYGLVCAAMNSETNEEVAIKKIGNAFDNRIDAKRTLREIKLLCH MDHENVIGLKDIIRPPSRENFNDWIWELMDTDLHQIIRSNQPLTDDH CRYFLYQLLRGLKYVHSASVLHRDLKPSNLFLNSNCDLKIGDFGLAR TTSETDFMTEYVVTRWYRAPELLLNCSEYTAAIDIWSVGCILGEIMT RQPLFPGKDYVHQLRLITELIGSPDDSSLGFLRSDNARRYVRQLPQY PRQQFSSRFQTMSPGAVDLLERMLVFDPIRRITVEEALCHPYLAPLH DINEEPICPTPFIYDFEQPSFTEENIKELIWRETLRFNPDPMH |
| 236 | MGQVPSASSSPEPSHRGGAISSSHRLDSLPSLEFVSSFEDEEDAAA ADEGAAAGYDYTGDLPDECLAHVFHFLGTGDRKRCSWCRRWRRVDGE SRHRLSLNAQADLLSSLPSVFSRFDAVTKLALRCDRKSVSLGDEALV LISLRCRGLARLKLRGCREVTDLGVAAFAENCRQLRKLSCGSCAINA VLDHCVNLEELSIKRLRGIHDGAEPIGPGAAAKSLRSICLKELINGQ CFGFLVGARKLSTLKLLIRCLGDWDNVLQTIGSSNPGLLEVHLERIQ VSDGGLCGIANCKGIDSLHVVKVPECSNLGLSSENCRQLRKLHIDGW RINRIGDEGLVEVAKQCLQLQELVLIGVSVTHSSLAAIGSNCRKLER LAFCGSDTVGDAEIACIAAKCEALKKLCIKNCPITDVGIESLAQGCP NLVKIKVRKCRGVSGQWELLKERRGSLVFNLDACGIEALDDIRGVQE SVMEFPPVNTSDAPSSSNERSMLFRAKLGLFAGRNLVACTFRRWSNG EHSTNGNL |

TABLE 3-continued

Cell Signaling Protein Sequences

SEQ ID NO | Sequence

237 MAYSFPEEVLEHVFSFIGSDRDRNAVSLVCKSWYEIERWCRRRVFVG
NCYAVSPAAVVRRFPEVRSVELKGKPHFADFNLVPEGWGGYVSPWIT
TLARAYPWLEEIRLKRMVVTDESLELIARSFKNFKVLVLSSCEGFST
DGLAAVAANCRNLRELDLRESEVEDMSGHWLSHFPDSYTSLVSLNIS
CLGSEVSFSALERLVSRCPDLRSLRLNRWPLDRLANLLRRPPQLAEL
GTGVYSAELRSDDFSNLVGALAGCRELRSLSGFWDWPAYLPAVYPLC
SGLTSLNLSYATIQSSELTKLISQCHSLQRLWVLDYIEDSGLEALAA
CCKDLRELRVFPSEPPFNREGNVSLTEQGLVSVSEGCSKLQSVLYFCR
QMSNAALLTIARNRPNMTRFRLCIIEPRCPDYITHEPLDTGFGAIVQ
HCKDLQRLSLSGLLTDRVFEYIGTYAKKLEMLSVAFAGDSDLGLHHV
LSGCDSLRKLEIRDCPFGDKALLANAAKLETMRSLWMSSCSVSFGAC
KLLGQKMPRLNVEVIDERGHPDSRPESCPVEKLYIYRWAGPRFDMPD
FVWTMDEDSALRP

238 MAQYEEDNAEFYVRYYVGHKGKFGHEFLEFEFRPDGKLRYANNSNYK
NDIMIRKEVWLTPAVLRECRRIISESEIMKEDDSNWPEPDRVGRQEL
EIVMGNEHISFTTSKIGSLVDVQTSKDPDGLRIFYYLVQDLKCFVFS
LISLHFKIKPI

239 MARRAEEEEYDYLFKWLIGDSGVGKSNLLSRFTRNEFCLESKSTIGVE
FATRTLQVEGRTVKAQIWDTAGGERYRAITSAYYRGALGLLVYDVTK
PTTFDNVSRWLKELRDHADSNIVIMLIGNKTDLKHLRAVATEDAQSY
AEKEGLSFIETSALEATNVEKAFQTILSEIYRIISKKPLSSEDAAPA
NIKEGKTIVVGESEANTKKACCSSS

240 MAVDCLTSKTSPAMPPQHKDEAREDKKHLVFDASVIRHQPDIPKQFI
WPDEEKPCANAPDLAVPLIDLDGFLSKDPSASEEASRLVGDACQKHG
FFLWNHGVDAGLISDAHKYMDKFFGLPLSEKQRAQRKLGEHCGYASS
FTGRFSSKLPWKETLSFGYSAEKSSANVVEDYFKNTMGEEFEQSGRV
YQDYCEAMSRLSLGIMELLGMSLGIGRDHFREFFESNLSIMRLNYYP
PCQKPDLTLGTGPHCDPTSLTILHQDQVGGLQVFVDNEWRSISPNFN
AFWNIGDTFMALSNGLYKSCLHRAVVNSRTPRKSLAFFLCPRSDKWR
PPSELVAMSCPRAYPDFTWPVLLEFTQKHYRADMNTLRAFTNWLQQR
TSEPVR

241 MASRRRMLLKVIILGDSGVGKTSLMNQWNRKFSNQYKATIGADFLTK
EVQFEDRLFTLQIWDTAGQERFQSLGVAFYRGADCCVLVYDVNVMKS
FDNLNNWREEFLIQAGPSDPENFPPVVLGNKVDVDNGNSRVVSEKKA
RAWCASKGNIPYFETSAKEGFNVEAAFECIAKNLNALKNEPEEEIYLPD
TIDVAGGARQQRSTGCEC

242 MLTISDEKLFHNCLLALYLIGPPTFISLRYIQAPYGKHHRSGWGPTI
SPALAWFLMESPTLWLTLLIFPFGKNSSNARSLILISPFLFHYFHRT
IIYPLRIRSSGGQRSTQPNAANRFPVTVAFMAFGFNLLNAYVQARWV
SNYESDGAAGGWWFWGRFLVGLVIFVSGMYMNMSSDMVLVGLKREGK
GYRVPRGGLFEFVSCPNYFGEIVEWLGWAVMTWSAWAGFGFFLYTCA
NLVPRARANHRWYLDKFGEEYPKSRKAVIPPLY

243 MAEAKTVHSPLVTYFSMLSLLTLCPPFVILLWYTMVHADGSIVQTFD
YLRQHGLQGFLDIWPRPTAVAWKIIAVYAFEAALQLLLPGKWKGPIS
PAGNQPVYKANGMAAYFVTLITYLGLWWFGIFNPTVVYDHLGEIYSA
LIVGSFIFCIFLYIKGHVAPSSTDSGSSGNIIIDFYWGMELYPRIGK
DFDIKVFTNCRFGMMSWAVLALTYCIKQYEQNGKVADSMLVNTILML
VYVTKFFWWEAGYWNTMDIAHDRAFYICWGCLVWVPSIYTSPGMYLV
NHPVNLGTQLALYILVAGILCIYINYDCDRQRQEFRRTNLCPSVWGKA
PSKISASYTTTSGENKTSLLLTSGWWGLSRHFHYVPEILGAFFWTVP
ALFNHFLPYFYVIFLTILLFDRAKRDDDRCRSKYGKYWKLYCEKVRY
RIIPGIY

244 MRSTKPLKPLKLAVPAPDAPIASFLTASGTFHDGDLLLNHKGLRLKS
EEKESCLSNGKELDLDFSLEDLETIKVIGKGSGGWQLVRHKWVGKLF
ALKVIQMNIQEEIRKQIVQELKINQASQCPHWICYHSFYHNGAFSLV
LEYMDRGSLADVIRQVKTILEPYLAWCKQVLQGLWLHNERHVHRDI
KPSNLLVNHRGEVKITDFGVSAMLASSMGQRDTFVGTYNYMSPERIS
GSTYDYSSDIWSLGMVVLECAIGRFPYMQSEDQQSWPSFYELLEAIV
ESPPPSAPADQFSPEFCSFVSSCIQKDPQQRSSLDLLSHAFIKKFE
DKDIDLGILVGSLEPPVSFPRC

245 MDSTTHSFQRRPLSIKLWPPSQSTRIMLVERMTKNLIAPSVLSRKYG
LLSKEEAEEDAKRIEESSAAIANQHMEKEPDGDGSSAVQVYATQSSKL
MLEVIKRGPRMKVDGEAILPAKAIAASETVFDISGGRRAFIDAEEEE
ELLKPKLAPGNFYKKICFSNRSFGLDAARVAEPPFLVSVKDKLTDVDL

SDFVAGRPEAEALEVMNIFSSALEGCNLRSLDLSNNALGEKGVRAFG
ALLKSQNNLEELYLMNDGISEEAALAVCELLPSTEKLRILHFHNNMT
GDEGALAISEIVKHSPVLEDFRCSSTRVGSDGGVSLCDALSACSRIK
KLDLRDNMFGVESGVALSKAIPSFADLTEWFSYLNLEDEGTEALAIA
LKESAPSLEVLEMAGNDITAKAGAVLAACIAAKQFLTKLNLSENELK
DEGAILIGKALEEGHGQLVEVDLSTNSIRRVGARVLAQAWQKPGFKM
LNINANFISEEGLDEVKDIFKTSPNMLGPLDENDPEGEDFDEEADEE
GAGHEDELEAKLKDLEIKHEE

246 MVKLTMIARVTDGLPLAEGLDDGRDVKDAEFYKQQVKALFKNLSKGQ
NEPSRMSVETGPYYFHYIIEGRVCYLTMCDRSYPKKLAFQYLEDLKN
EFGRVNGAQIETAARPYAFIKFDTFIQKTKKLYQDTRTQRNISKLND
ELYEVHQIMTRNVQEVLGVGEKLDQVSEMSSRLTSESRIYADKARDL
NRQALIRKWAPVAIVLGWFLLFWVKSKIW

247 MSYVSSNRKPLLSRKATNDGHAEKSPYFDGWKAYDKDPFHPTQNPSG
VIQMGLAEHQLCFDLVQEWLVSNPEASICTKKGVDKFRDIALFQDYH
GLPAFRNAVAKFMGRVRGDKVKFDPDRIVMSGGATGAHEMITFCLAD
PGDAFLVPTPYYAGFDRDLCWRTEARLLPWCHSSNNFKVTRKALEEA
YAKAVEANISVKGLLLTNPSNPLGTILDRDTLREAMSFINEKNIHLI
CDEIYAATVFRQPDFISIAEIIEEDQEYNRNLVHIIYSLSKDMGFPG
FRVGIVYSYNDAWECGRRMSSFGLVSSQTQYLIASMLSDDQFIGKFL
LESAERLETRHKNFTDGLHQVGICLCLNGNAGLFLWMDLRELLMESTV
EAETALWRGIINEFKLNVSPGSSFHCSEPGWFRVCIANMNEETMKVA
LARIREFVRRNGDKLNRKEKCRQSDLRLRLSFRRMDDVLRSPCIMSP
HSPIPQSPLVRTRT

248 MATLVEPPDGVRQRGKQYYSMWRTLFEVDAKWPIKPIGRGAYGWCSS
INRETHEKVAIKKIHNVFENRIDALRTLRELKLLRHIKHENVIALKD
VMLPVHSASFREVYLWELMDTDLHQLIKSPQPLSNEHCRFFIFQLLK
GLKYLHSANVLHRDLKPGNLLVNANCDLKICDFGLARTNQGDGQFMT
EYVVTRWYRAPELLLSCDNYGTSIDVWSVGCIFAEILGRKPLFPGTE
CLNQLRLIIDTLGSQGEEDIEFIDNRKARRYIKALPFSRGTHFSQLY
PQADPLAVDLLQRMLVFDPRKRITVTEALQHPYMAGLYDPRGNPPAQ
YPINLDIDDSMEQHMIREMMWNEILHYHPHQYASLHG

249 MGQQSLIYSFVARGPVLLAEYTEFSGNFTSVASQCLQKLPATSNKFT
YNCDGHTFNYLVDYCWAVESVGRQIPMAFLERIKEDFTHRYDAGKAA
TASANSLNREFGPKLKEHMQYCVDHPEEISKLAKVKAQVSEVKGVMM
ENIEKVLDRGEKIELLVDKTDNLRSQAQDFRQQGTKMRRKMWLQNMK
IKLIVLGIIIALILVIVLSVCHGFNCGHK

250 MADVAGLTEAAGSRFSSLELIGRGSFGDVYKAFDKELNKEVAIKVID
LEESEDEIEDIQKEISVLSQCRSPYITEYYGSYLHQTKLWIIMEYMA
GGSVADLLQSGPPLDEMSIACILRDLLHAIEYLHTEGRDIKAANILL
SENGDVKVADFGVSAQLTRTISRRKTFVGTPFWMAPEVIQNSDGYNE
KADIWSLGITAIEMAKGEPPLADLHPMRVLFIIPRENPPQLDEHFSR
SIKEFVSLCLKKVPAERPSAKELLKHRFIRNARKSPRLLERIRERPK
YPTVEDGETPMIGKGVVEGSDTVKIRRDIKGEETVRASNQGRGGKNT
GWDFSIGGVQGTGTVRTNLLPPQVRERKSENSHNQATPRRVADGGNS
WLSASGNSPQAAEISLRKDARDLHYNNHHDDEDSSLSGSGTVVVRTP
RESQPSPLLRDQSTLSSSSYSSVEDASTTGTVVFRGQHDESDSPRTP
KSRLGIQERSSSASLEDSAANLEAEKAAMQGAFKRGNAREKRSVLGK
FNDGQENGNREQLTKSPDSSRNSYEYFDAHKVLPRSRQASDDEDIAK
ILSSSAPLSVLLIPSLKETTGDDSDGPWHAVSTSLTNLERMKPGSCE
VLISKLLQRLASSKESSLKDLQDLATHTFSKGKISPEKSGNANTEAD
NRKKQQNKEFNSNANLSPLARFLLSRWQGQVSRDLNPT

251 MSQKGLIYSFVAKGTWLAEHTQFSGNFSTIAVQCLQKLPSNSSKYTY
SCDGHTFNFLTDSGFVFLWADESVGRSVPFVFLERVKDDFMQHYSAS
IASGDPHPLADDDEDDDLFQDRFSIAYNLDREFGPRLKEHMQYCMSH
PEEMSKLSKLKAQISEVKGIMVDNIEKVLDRGERIELLVDKTENLQF
QADIFQRQGRQLRRKMWFQNLQMKVVVAGAWIVIFLLWLIAKWGSK

252 MEGEEQKPAATKRRKPRSGAPSSAPINNLDDGCLMHIFSFLSPIPD
RYNTALVCHRWCYLACHPRLWLRVDRSVDSSEPGVFPNIELAVSAAR
PGDTILIAAGGSHVASNIQUKKPLCIGGGELPDETMLLCSRGSDSA
LEFLSTCKLSNLTVKAELGCCLLHRSGRLIIDGCILQCETDPLDYUL
SCPIVSTATGSKVVSSPNGCHGDVGSVSRTRIEGGAKAVLTSGDLAL
QRVRVICARTSMFFWFDVECPS

253 MGQSSSSTAPALGGRGADPDPDPDPDDGHSAAKSKAVIWPVLGEAAA
EECAAPDLSLSISDLPDECLACVFQYLGSGDRARCSLVCRRWLAVEG

TABLE 3-continued

Cell Signaling Protein Sequences

SEQ ID NO | Sequence

QSRQRLALHAQSELLEAVPALFARFDSVSKLALKCDRKALSIGDDAL
VLISLKCRNLTRLKLRGCRALTDTGIAVFTSNCRGLRKLSCGSCAFG
AKGLNAVIDHCASLEELSVKRLRSPTEGAMEPIGPGAAAASLKTICL
KELYNGQGFGPLIIGSKNLRTLKLVKCYGDWDTVLQVMVERVAKLVE
IHLERIQVSDFGIASLSNCSDLEILHLLKTPHCTNLGLISVAERCTL
LRKLHIDGLKLNRIGDDGLIAVAKRCPNLRELVLIGVNPTELSLDLL
GSNCLTLERLAFCGSDWGDAEIMCIAARCVALKKLCIKNCPVSDEGM
KALASGCPNLVKLKVKKCGGVTSEGAAWLRMRRGSLALNLDSSDQEQ
IDAFASDGGGEENHVEFPPVPSQTAGANIASSSGTSRSSSFKSRLGS
LRGKSLMACTFRRWSSGSKDS

254 MGEESFIYSFVARGTMILAEYTEFTGNFPAIAAQCLQKLPSSNNKFT
YSCDHHTFNFLLEDGYAYCWAKESVAKQISIAFLERVKVDFKKRYGG
GKADTAVAKSLNKEFGPIMKEHMKYIIEHAEEIDKLIKVKAQVSEVK
SIMLENIDKAIDRGENLTILADKTENLRDQAQAYKKQGTQIRRKMWY
QNMKIKLVVFGILLFLILVIWLSICHGFDCSN

255 MAGGYRADDDYDYLFKWLIGDSGVGKSNLLSRFTRNEFSLESKSTIG
VEFATRSIRVDDKVVKAQIWDTAGQERYRAITSAYYRGAVGALLWDV
TRHVTFENVERWLKELRDHTDSNIVIMLVGNKADLRHLRAVSTEDAT
AFAEKENTFFMETSALESMNVENAFTEVLTQIHRWSRKALEAGNDPG
ALPKGQTINVGSKDDVSEVKKVGCCSS

256 MAELAGDLPGELVTEILDRLPVESLLRCRSVSKRWRGIIDSREFVRS
HLARSFESTANLTLFFRHSSSLYCIDLTSLLRHGGVAEMNYPLMCYS
DQIRVLGSCNGLLCISNAADDVVVWNPATRKHKFLPYSAVEVRRSSV
FSVCWGFGYDERRDDWLLRLVQLVTEPIESEVSIVSLQDNAWRRLKD
MPYSLVYPRKMGVFVCGHLHWIMTRELVSDSANLLVAFDFRIEDFKV
VDQPEGIDNKLDMDLSVLGGCLCLSINGNHMGVHVVVIMKEYGLRDS
WTKLFSIPQSEVARPLGFVRPLAYASNGRQVLVRQDSKNLILYDLET
KGMERVDINGMPNSFEAEICLRTLVSVDDYGGYTKKKQQEAEEIENR
TKRDDFLSVGFKLVL

257 MADTATRAIPPRMEFSDEAAAGGAAAPAAAAAAAEEEEEEEAPSPA
AEISEVEKSKIGIMRAVVERDDPSAKDVDDFMIRRFLRARDLDIEKA
SKLFLKYLSWRRSFVPNGVISASEVPNNLAQRKLFMQGLDKKGRPII
VVYGGRHNPSKGSLEEFKRMILLRMPGGQEKFMGIADLEGWGYKSSD
IRGYLAALSILQDCYPERLGKLFLIHVPYIFMTAWKMVYPFIDPKTK
KKIVFVDNKKLRTTLLGDIDESQLPDVYGGRLPLVAIQDS

258 MAARLFSSLLSRSSSAASSSSSSSSARALLSRARKPLLGREIKSYST
AAAIEEPINPGVWNHTQLFINGQWDSASGKTFPTFDPRTGEVIAHVA
EGEAEDINRAVAAARKAFDEGPWPRMTAYERANVLFRFADLLEKHND
EIAALETWDNGKPYEQAAKIELPMIVRQIRYYAGWADKIHGLTVPAD
GQYHVQTLHEPIGVAGQIIPWNFPLLMYAWKVGPALATGNTWLKTAE
QTPLSALYATKLLHEAGLPPGVLNVVSGFGPTAGAALSSHMDVDKLA
FTGSTDTGKIVLELAAKSNLKPVTLELGGKSPFIVCEDVDKAVELAH
FALFFNQGQCCCAGSRTWHESIYEEFVEKAKARATVRSVGDPFKSGI
EQGPQIDSEQFQKILRYIRSGVEGGATLETGGERFGTKGHYIQPTVF
SNVKDDMLIAKDEIFGPVQTILKFKDLKEVIQRANNSRYGLAAGVFT
QNIDTANTLTRALKVGTVWVNCFDVFDAAIPFGGYKMSGHGREKGVY
SLSNYLQVKAWTSLKNPAWL

259 MSSSSSGGGGGAKLPHDVAVEILKRLPARSLLRFRCVCRSWRSAI
DDPRFVALHWSHSALHASSRHLACLDCGDDAVQNRCSLFPNAPLALP
PPPSQIEIPFVAPPNRYALVGSCNGLICVSESSSDGTERALYFEWHL
TRKHKAVRLPRPERMPPFSVGGAHWLGFCFDAKSNDYRWRIIRYLGI
RRRFRNKKPRVEWSFRTDSWKTLECEVPLLCDSAVFLNGNLHWYSFN
GEGDGYGSIVLFNVAEVFDEIALPEGISPHFVLSVTVLNESLAVFFS
HREACMKDYGVPESWSKLYTFEVTEPVTGFDGFTWNGELLMEINCEE
RVSWNPITAQLSILPLSARYKLVPWESLVPP

260 MDAAPLTSQRRPFSVKLWPPSKNTRETLVERMTRNLTSESIFTRKYG
SLSPEEAEENAKRIEDEAFTTANQHYEKEPDGDGGSAVQLYAKECSK
LILEVLKKGPKGKDEKPPTSDSAKAPRETFFDISKGQRAFIEAEEEE
ELLRPLKEPENSFTKICFSNRSFGLGAAHVAEPILISLKQQLKEVDL
SDFIAGRPETEALEVMSIFSAALEGSVLNSLNLSNNALGEKGVRAFS
ALLKSQSQLEELYLMNDGISEEAARAVCELIPSTEKLRVLHFHNNMT
GDEGAIAIAEWKCSSLMEDFRCSSTRIGSDGGVALSEALENCIHLKK
LDLRDNMFGVDAGVALSKALSKHTNLTEVYLSYLNLEDEGAIAIANV
LKETASSTVLDMAGNDITAEAAPTLSACIMKNLLTKLNLAENELKD
EGAIQIGKALQEGHEQLTEVDLNTNSIRRAGARFLAQVVVQKPGFKL

LNIDGNFISEDGIDEVKSIFKKSPEMLASLDENDPEGGDEDEEDEEG
EAEGEADEGELESKLKNLEVGEE

261 MALVRERRQLNLRLPLTDLPNRRPLFPPPLSLPLPPSMAAASATAAA
GSGAAATSLSDLESLGVLGHGNGGTVYKVRHRRTSAVYALKVVHAGC
DATVRRQVLREMEILRRTDSPHWRCHGIFEKPNGDIAILMENMDAGS
LQTLLEASGTFSEKQLAAVARHVLNGLHYLHSLKIIHRDIKPSNLLV
NSAMEVKIADFGVSKIMCRTLDACNSYVGTCAYMSPERFDPDSYGGN
YDGYAGDIWSLGLTLLELYLGHFPLLGPGQRPDWATLMCAICFGEPP
KSPDGSSEEFRSFVECCLQKESSKRWSVAELLNHPFIAGGKDPAGSL

262 MVSAAQAAGGSLSLSLSLRDREILTSVNSVASSFSLLGSGFIVLCYL
LFKELRKFSFKLVFYLALSDMLCSFFNIIGDPSIGFFCYAQGYTTHF
FCVASFLVTTVIAFTLHRTWRHKTDVEDLEAMFHLYVWGTSWMTIIR
SIGNDHRHLGAWCWSQTGRTGKAVHFITFYAPLWGAILYNGFSYFQV
IRMLNNATRMAVGMSDRAYHLDARPDMKALNRWGYYPLILIGSWTFG
TINRIHDFIEPGHKIFWLSLLDVGTAALMGLFNSIAYGLNSSVRRAI
RERLDLVTWPETIRPWLPNSSRIRHQQQESELVSLKSQDPH

263 MAGLSDDLITKILDRFPKESLIPFRCVSKQWRRLIDDRFFRKSLLYL
VPMYSSSLYRIGLRRLGDLVEIENPFESEQIVLLGSCRGFLCIYNEI
DGQIAIWNPSTRSCQLLPPADAEIAHRLGPPACVYGFGYDYWNDEFV
LLRLVQTMEDPILSVSIYRSRGSVWRRLQGIPPYSLVEPRTMGVFLR
GRLHWIMRRDPMQNSAIVLVAFDIHTENSVEVQQLNFIDNRLPMYLA
ILEGGLCLIINDERGGVSAWIASEYGSEESWARLFSIADYSMGRVLL
QPLAYSQNGRQVLLLYRETLVWYDLDTGDVENINSMLSISNTPIVGD
YLGSRRRRLQGAWRQLEGMSYSLGNACKRGIFLHGRLHWIMTLQLVL
NSTKVLVAFDIRSDKFMEVSELNFIDNRLNMDLTLLGGCLCLIIYGE
QRGVHAWIMREYGLNRPWYMLFSMPGHSRPLLAYSQNGRQVLVAVGG
KTLVWYDRVWYDLHTGGVKKFGKRGMPSSYEAEIYLRTLVPVGKPPI

264 MAGGEAFSSNPPPPKPAILGNNSKTINAKLVLLGDMGAGKSSLVLRF
VKDQFFDFQESTIGAAFFSRTVGVNDASVKFEIWDTAGQERYHSLAP
MYYRGAAAAIVVYDITSTESFERAKKWVEELHKQGNPNLIITLAGNK
TDMEDKRKVAAEEEACMYAEERRLVFIETSAKTATNVSKLFYEIAKRL
PRVQAMQNSAPAGMVLADTSSEETRSASCCS

265 MEIPMIDLSELDGKNRSKTMALLHHACEKWGCFKIKNHGVDPELMEK
VKHFVNTHYEENLKASFYESETAKCLENANGATSDLDWECTFIVHM
PKSNIEDFPNLSNDLRKTMDEYIAQLVKLAENLSELMCENLGLGKDH
IKRAFSGKDGPSVGTKVAKYPECPYPEKVRGLREHTDAGGIILLLQD
DQVPGLEFLHDDQWVPIPPSTNDTIFVNTGDQLEVLSNGRYKSVWHR
VMAVESGSRLSVATFYNPAGDAIISPAPKLLYPEKYTFGEYLKLYAT
TKFQEKEPRFESMKSVMSNGYNGW

266 MATVPQEAINELQALMDRVDEPLMRTFENIHQGYLKETLVRFLKARE
GNVAKAHKMLLDCLKWRVQNEIDIILSKPIIPDDLYRAVRDSQLIGL
SGYSKGLPVYAIGVGLSTFDKASVHYYVQSHIQINEYRDRVLPSA
SKRYGRPITTCLKVLDMSGLRLSALSQIKLLTIISTVDDLNYPEKTN
TYYIVNAPYVFSACWKWKPLLQERTRKKVQVLPGCGRDDLLKIMDYS
SLPHFCKGEGSGSGRHTSYGPENCYSLDHPFHQQLYSYIKEQSQRRQ
PIQGKIPKQGSFHVALPEAAAEGTEIAKTIESELQKFENGSGMPDSLDG
LKINGE

267 MARAGNKNIQAKLVLLGDMGAGKTSLVLRFVKGQFHEYQESTIGAAF
FTQVLSLNEATVKFDIWDTAGQERYHSLAPMYYRGAAAAVVVYDLTS
MDSFQRAKKWVLELQRQGNPKLIMFLVANKADLEQKRQVLSEEGEQY
AKENGLSFLETSAKTAQNVELFYEIAKRIAKATPSRPTGMKLQRQE
SRRSLFCCSG

268 MSTLSEDDETEILLRLPVKSLLKFKSVCKPWNSLISSPYFAKTHLQI
SASSPRILLATNPPLSVSCESLHDDDRAGHEGTPLTQLRPPVEAPDG
CRPRIVGYCDGLVCLEYDDHRIWLWNPATGESRNIPNASCSYNRPTI
CGLGYDDPSTDDYKILRHCSVADAYGFPEYSVFDVFALKTGSWRRVHD
KHDEFNWVPEAGTYANGFLHWLWGRDPWEHKKIVSFSMSKEKFEDAL
LALPEANEGTGFRVLGVAGECLLIYKSMAEVDTFMAWMMSDYGVRSS
SSWMELCSVTLPNQTLNTYFYMRPLCSTRAGKIAFSSIGTTRLSMIL
RNVMTKWFVKEDKLDFWVESFVSPHGAKLQNQYVSRVKEPMERSDF
IGDHSVFKEGETSYKKANSHLSSKRRKAS

269 MEIFPVINLEKLNGEERGVTMEMIRDACENWGFFELVNHGISHELMD
TVERLTKGHYKECMERKFKEMVASKGLAVQSEIGDIDWESTFFLRHL
PVSNISEVPDLKEDYRKVMREFALEIEKLAEQLLDDLLCENLGLEKGY

TABLE 3-continued

Cell Signaling Protein Sequences

SEQ
ID
NO Sequence

269 LKKVFYGSKGPTFGTKVSNYPPCPNPELFKGLRAHTDAGGIILLFQD
DKVGGLQLLKDGKWIDVPPLRHSIVINLGDQLEVITNGKYKSVEHRV
IAQSDGNRMSIASFYNPGSDAVICPAPALLKKEAGEEGQAYPKFVFE
DYMKLYARLKFQAKEPRFEAMKATESTIARGPIATA

270 MQVSQPARPSDPIYRRDDHLSQACKDLVSSLPSEEGWVATSFCLYQG
FWFPTWLFNGVLACQNHFQAQPSDILLVTNPKSGTTWLKAILFALLN
RAKYSDSDSKQRHPLLTQNPHDLVPFLEVKLYLQQENPDLTTFESPR
LFATHLPYSSLPGSVRDSRCKLVYLCRNPKDMFISLWHYVNKRRAEE
KGQIPLPKCLDKFCRGLSPYGPYWDHVMGYHKASLEMPEQVLFLMYE
ELKEDPRVHVSRLADFLGCPFSDEELRDGTVEGIMRMCSFDNLSSLE
VNKSGKLWTGQENQWFFRRGKVGDWVNYLSAEMADKIDQVMEEKLRD
SGLNFQYK

271 MDPTKKPRESSSSTASAAAAEFPDEVLERVLALLASHKDRSAASLVS
KAWYHAERWSRTRVFIGNCYSVTPEIVAGRFPKIRSVTLKGKPRFSD
FNLVPQNWGADIRSWLTVFAERYPFLEELRLKRMTVTDESLKFLALK
FPNFKALSLMSCDGFSTDGLAAIATRCRNLTELDIQENGIDDISGDW
LSCFPENFTSLEVLNFASLNSDVDFDALERLVSRCNSLKVLKVNRTI
SLDQLQRLLVRAPRLTELGTGSFLQELNAHQYSELERAFGGCKTLHT
LSGLYEAMAPYLPVLYPACANLTFLNLNDAALQNEELAKLWHCPCLQ
RLWVLDTVGDEGLGAVARSCPLLEELRVFPANPFDEEVNHGVSESGF
LAISYGCRRLHYVLYFCRQMTNAAVATIVQNCPDFTHFRLCIMNPGQ
PDYLTNEPMDEAFGAWKRCTKLQRLAVSGLLTDQTFEYIGTYAKNLE
TLSVAFAGSSDRGMQCVLRGCPKLRKLEIRDCPFGNAALLSGLEKYE
SMRSLWMSACKVTMNGCAVLARERPRLNVEVMKDEESSDGQAYKVYV
YRTVAGPRRDAPPFVLTL

272 MSSSAVQFAAASRDGHENNGGGGGDSSGERLDPTAVLLPVDPGAPDL
SLPRETFLRAALSLKDQWQATWREGGAADPTAYTGLLGTAFLCLRSY
AATGDRGDLLLSAEIVDACASAARASTRHVTFLCGKSGVPFAVGAWAN
LLGDHHKRDFFLNLFLEVAQERALPVGPEEGGFGMSYDLLYGRAGFL
WAALFLNKNLGEETVPNNVLMPIVDAVLAGGRAGASDIATCPLMYRW
HGTRYLGAANGLAGILQVLLHFPLCEEYLEDVKGTLRYIMSKRFPHS
GNYPSSEGNPRDKLVQWSHGATGMAITLCKASQVPFPHDRDFRDAAIT
AGEVVWKNGLVKKVGLADGISGNAYAFLSLYRLTGERIYEDRARAFA
SFLYHDANKPVGTGHGHVADYAFSLYQGLAGAACLWFDLVDAENSRF
PGYEL

273 MQILPSPEESITCSGPHYDRAKEAKEFDETKAGVKGLIDSGMAKVPR
LFIHPPQNLRDLSSDTEGSATDLKVPIIDMMGCQDSQLRRDWDDLRR
ASETWGFFQIINHGIPVDVMDGVLEAVKQFHEQPEGVKGEWYSRDDA
RKFRYYSNGDLFWSKAATWKDTLLFDFPFGEPDREAVPLLFRETVFE
YEKHVEKLKGSLSELLSEALGLDSGYLGDIECMDSKRIVSHYYPTCP
EPELTLGTINHSDATYLTLLLQNHNGGLQVRHQNQWVDVSPVPGAIL
VIIGDFMQLVSNDKFKSVEHRVLARRAGPRVSVLCFLFPGETRKSKP
YGPIKELLDENNPPMYRETSFTEYFGYYLSSGNGLNGESVLPHFRVS
EPK

274 MLKKLASGIFISSLLITVSVADNGFPRCNCDDEGSLWSVESILECQR
VSDFLIAVAYFSIPIELLYFISCSNIPFKWVLFQFIAFIVLCGLTHL
INGWTYAHHPFQLMVALTVFKILTALVSCATAITLITLIPLLLKVKV
REFMLKKKAWDLGREVGIIMKQKEAGLHVRMLTQEIRKSLDRHTILD
TTLVELSKTLGLQNCAVWMPNNGKTEMNLTHERGRNYSGTYHIPIPI
TDPDWSIKQSDQVHILRPDSELATASSVGPGESGPVAAIRMPMLRVS
NFKGGTPELHPACYAILVLVLPGGEPRSWSNQELEIIKWADQVAVL
SHAAILEESQLMREKLEEQNRALQQEKRNAMMASQARSSFQKVMNDG
LKRPMHTISGLLSIMQDESLNADQKIIGNAMARTSAVLANLINDWNM
STKNSGRFPLEVRSFSMHDMIREAACLAKCLCIYKGFSFELDIDRSL
PNNVMGDERRVFQVILHMIGNLLNDSNQGLKVLTLRILREKASGSQR
YDRGWVTWRSESTDRGVRIKFEVGISDDISLLERSVSTIQLGGRKYN
SDGVEEDFSFSICKWLVQLMQGNIWVVPNTQGFAQSMTLVLRFPLRE
SISVTISEPGPSPDYTLSNSVFTGLKVLLVDSDDANKAVTRKLLEKL
GCKVSTASSGFECLGALRSPESSFQIVLLDLHMPSLDGFEVANKIRQ
FHSSTNWPVIVALTTSGDDIWERCLQVGINGVIRKPVLLHGMANELR
RVLLQPSKTLL

275 MAGYRAEDDYDYLYKWLIGDSGVGKSNLLSRFTKNEFNLESKSTIGV
EFATRTLTVDGKWKAQIWDTAGQERYRAITSAYYRGAVGALLVYDVT
RHATFENVDRWLKELRNHTDPSIWMLVANKSDLRHLIAVSTEDGKSY
AERESLYFMETSALEATNVENAFAEVLTQIYRTTSKKTVEGDDGSAA
AFPSQGEKINIKDDVSALKKVGCCST

276 MQPSQPPPLNENYLRDDVKSQECEDLHSSLPSEEDWVPTSLPSEEDC
VPSTLRLYQGFWFPSWVLNSWACQNHFQAHPSDILLVTSPKCGTTWL
KAILFALLNRAKYSDSNSQKRHPLLTQNPHDLVPFLEFRLYLQNKNP
DLTAFASPRLLATHLPYSSLPRSVRDSNCKLVYLCRNPKDTFISMWH
YFNKLRPEEKGQLPLPEGLDKFCRGVNWCGPYWDHVLGYHKASSEMP
EKVLFVKYEEMKADPSVQVRRLADFMGRPFSEEELRNGTVEGILRMC
SFDNLSALEVNRSGKLPSGLEKKWFFRKGEVGDWVNYMSAEMGEQID
GVMEEKLHGSGLKF

277 MAILYAWARGTWLAEFSAVTGNTGAVARRILEKLPSEADSRLCFSQD
RYIFHILRSDGLSFLCMANDTFGRRIPFSYLEDIQMRFMKNYGKVAH
FAPAYAMNDEFSRVLHQQMEFFSSNPSADTLNRVRGEVSEMRTIMVD
NIEKILDRGDRIELLVDKTATMQDGAFHFKKQSKRLRRALWMKNAKL
LALLLTCLILVLLYIIIAACCGGITLPNCRS

278 MTGTMIGVTNANEQQALDRAQEVRQFEDSNLGVKGLLDSGLSTLPPM
FIHPPDDLLSSLKPWGLKTDSIPIIDLSGSNSDRRPSVIEEVARAARE
FGFFQIVNHGVPTEVLGQTIAAVKAFHEQPAEVKARIYRRESETGVA
FFASSVDLLHSNVACWRDSLRIRSGPVLPDEEEIPEVCRNEVMEWNQ
QTQHLGVLLMGLLSEGLGLSPSKLQDMTCVEKRNMLGHYYPYCPQPD
LTVGLKPHTDKGVITVLLQDQVGGLQVKHGEAWLDVTPSPGVLIVNI
GDLLQIMSNDEYKSVEHRVLANPGPEPRLSVAVFYYPLECENQIGPI
PELVSPEKPAAFRQFKLGEYLKRFQTEVLDGKTLKNHFKT

279 MWASPNPRRAEKIQAVELPAIDLSPSGRSAAPRLIVEACERYGFFKA
VNHGVPAEIVSRMDEASAGFFARPASEKRLAGPADPFGYGSKSIGFN
GDVGVEYLLLESDPAFVSRRSASISDDPTRFSAAVNVYIEAVKDLA
CDILDLMAEGLGVRDTSVFSRLIRAVDGDSVFRINHYPQCAVLHGEV
GFGEHSDPQILTVLRSNNVGGLQISLEDGWVTPVPPDPAAFWINVGD
LLQAMTNGRFSSVRHRAVTNPFRSRTSIAFFGAPPLDARIAPQRELV
TPRRPRLYNPFTWAEYKKAAYSLRLGDKRLDLFKACREDGIDL

280 MYRIQAGSAAAAGVPEGYCVETDPTGRYARFEEILGKGATKTVYKAI
DEVLGMEVAWNQVKLNDSFRSPDEYQRLISEVHLLSTLNHDSIMKFH
TSWVDVDGTAFNFITEMVTSGDTLRNYRKKYPRLHIRAIKNWAVQILH
GLVYLHSHDPPVIHRDLKCDNLFVNGHLGQVKIGDLGLAAILHGSRA
AHSIIGTPEFMAPELYDENYNELVDVYSIGMCVLEMLTCEYPYIECT
NPAQIYKKVTSGKLPEAFYRIKDSKARKFIGKCLANVSCRVSARELL
HDPFLLSDEGDRLPGLKFKMPEPFLNGRDVDNLRARDNPLRTDMMIT
GKLNPEGDTIFLKVQIADRNSARNVYFPFDVLNDTPIDVAKEMVKEL
EIMDWEAEEIADMIGGEISALVPNWTKQDMTDYNQENDDGFAPPFLS
FSSGSSSQASPSGFTAYRENEIASDYGCLQDVPDDMSSPSSIHSGTY
SHTSYFCPEDQEVNPGPSNPDQHLISRSNRHTRFCADDYQPRPQFKD
RSQTLQCQVLTGSDRDSSSVINRRMAGHRLSRNRSLVDVHSQLLHLS
LLEEVSKRRLSRTVGEVENIGFQAPFEISRNAPWIGGSSFISSSRNK
KGHRIQNRRN

281 MDAGYLFKEETSLYNRIVLGSLLPASAWEPMPRLLQTWLRNYIGGTL
IYFLSGFLWCFYIYYLKRNVYVPKDEIPTRKAMLLQIYVAMKAMPWY
CALPTLSEYMVENGWTKCFSRISDVGWLAYLVYLSIYLVMAEFGIYW
MHRELHDIKPLYKHLHATHHIYNKQNTLSPFAGLAFHPLDGILQAVP
HVMALFLVPTHFTTHIALLFLEAIWTANIHDCIHGKLWPVMGAGYHT
IHHTTYRHNYGHYTIWMDWMFGTLRDPIDDGSKKEM

282 MAHQQLCSQSAIAGTEEHERKETDELIASLPQRKGAVRPFQCLYQNF
WSPIFVLPNVITFQRHFEAKHKDIVLASQPKSGTTWLKALVFSIVNR
FRFGISNTPLLTSNPHELVPFFEFQLYGSKLRPNLDGLAEPRLFATH
IPYPSLPECIKRSECQIIYICRNPLDTWSSWHFFLEKARLEDQPEWS
LEEHFETYCQGTISFGPFWDHIMGYWKMSLEWPSKVLFLKYEDLKED
TWHLNRVAEFVGLPFTEEEEAGVIEEIAKMCSLKTLKDLEVNKSGK
VALTIEFEKRSFFRKGEVGDWVNHLTPSMVDRLNSIIQEKMSPFGLE
FKTC

283 MPESREDSVYLAKLAEQAERYEEMVENMKRVASSDQELTVEERNLLS
VAYKNVIGARRASWRIVSSIEQKEESKGNEAQVSMIKGYREKIEQEL
AKICEDILEVLDKHLIPSAASGESKVFYHKMMGDYHRYLAEFATGDK
RKDSADKSLEAYKAASDAVTELPPTHPIRLGLALNFSVFYYEILNS
PDRACHLAKQAFDDAIAELDTLSEESYKDSTLIMQLLRDNLTWTSD
MQDSADKPADTKEEAGDAPAED

284 MSSSSSGGDGGGGPKLPHDVAVDILKRLPARSLLRFRCVCRSWRSAI
DDPRFVALHLSHSALHASSRHLACLDCGEDAVQNRCSLFPNAPLALP
PPPLQIEIPFVAPPNRYALVGSCNGLICVSESSSDGTERALYFWNLF

TABLE 3-continued

Cell Signaling Protein Sequences

| SEQ ID NO | Sequence |
|---|---|
| | TRKHKAVRLPRPERMPPLSVGGAHWLGFCFDAKSNDYRWRIIRYLGI RRRRFRNKKPRVEVYSFRTDSWKTLECEVPLLCDSAVFLNGNLHWYS FNGEGDGYGSIVLFNVADEVFDEIALPEGISPHFVLSVAVLNDSLAV FFSDGEACFVWVMKDYGVPESWSKLYTFEVTGPVTAFDGFTWNGELL MEINCEERVSWNPITAQLSILPLLARYELLPWESLVPP |
| 285 | MPSRRRTLLKVIILGDSGVGKTSLMNQYVNKKFSNQYKATIGADFLT KEVQLDDRLFTLQIWDTAGQERFQSLGVAFYRGADCCVLVYDVNVMK SFDNLNNWREEFLIQASPSDPENFPPFWIGNKIDVDGGNSRWSEKKAR AWCASKGNIPYFETSAKEGVNVEEAFQCIAKNALKSGEEEEIYLPDT IDVANSSQPRPSGCEC |
| 286 | MAHLNQFVGRTANLCLCVQQNSRLPYLSGVPSVEDLKYRLMGPSDQI RVLGSCGRLCIIDVADEINVWDPSTRQSMPLPHSAVEIRRPSALPIC VYGFGCDVRNGAFKLLRLIQLATGQRRSEVSIYNMIDQNWRRLPEIA YNLVYPDKMGVFAYGRLHLTVTPERLACSPAKLLLAFDCHTEEFEEV ELPDNIDKKRDMVVAVLDGRLCLSIDRIDMFADVWILRVYGSQESWA WVFSIPKYDDDRIPRFVWPLACSEDHHHVLVRKDNKDVVWYDLHARY INRVDIRGMPSSFKDAYVM |
| 287 | MGAWLGCILGLIPLLGCCLWWWNEIRYVWPVKRRCSGTNAKLPPGHM GFPPFFGELFTFLWYYKILRRPDEFINSKRKKYGDGVGMYRTHLFGSP SIIACVPSVNKFVFRAEDTFIAQWPNVDIMGTNSLGAVHGKAHDRLR SFVLNAVNRPDALRRIAALVQPRLVSALELWAQKGRIVAFHETKKVT FENIGKLFVSFEPGPQLEKIDGLFHDMLKGMRAQRLNFPGTAYRCAL QARKKVEAIFRVELEERKSRSEETVTDLMDELRQIKDEEGRKLSDQE VLDNIVSFVFAGYESTSLASMWAIYYLAKSPNVLKKLREENTSVSQN KKGEFITSEDISNMKYTKKWEETLRMANISHFLFRLVTKDIEYKGYR IPKGWKVILWLRYLHTNPENFDDPMCFNPERWNDSVKPEAYQVFGGG SRICPGNMLARIQLAILLHHLSVEYKWELINSDAGFVYLPHPAPVDE VEVSFSKL |
| 288 | MWPSKLAIEQFSYVMNSNALSSHQIPWDLSKPDSKSLIIKACEECGF FKWNHGVPLDFISRLEEEAVKFFSLPLPEKERAGPPDPFGYGNKMIG RNGDVGWIEYLLLTTDPNFNYRKLPSAFNENPERPRSALSDYTSAVR YMACEILELMADGLRIQQRNIFSKLLMDEQSDSVFRLNHYPPCPELQ SYVDRNMIGFGEHTDPQIISVLRSNNTSGLQISMKDGTWVSVPPDQN SFFINVGDSLEVMTNGRFRSVRHRVLANTSKSRVSMIYFGGPPLSEK IAPLPCLMKGKESLYKEFTWFEYKKSAYNTRLADNRLEHFQRVAAS |
| 289 | MAWIFLALGWLVLCVCTALLRWNEVRYMKKGLPPGTMGWPVFGETTE FLKQGPNFMKNQSARYGSFFKSHILGCPTIVSMDPEVNRYILMNEAK GLVPGYPQSMLDILGKRNIAAVHGASHKHMRGALLSLVSPTMIRDQL LPKIDRFMRSHLARWDDGSIIDLQDKTKQMALLSSLMQIGIDSSSIS QEFIPEFFKLVLGTLSLPIDLPGTNYRRGFQARKNILGMLRKLIEER RASQEAHNDMLGCLMRSDDNKYKLNDEEIIDQIITIMYSGYETVSTT SMMAVKYLHDNPSVLHELRKEHLGIRAKKRPEDPIEWDDLKAMRFTR AVIFETSRLATWNGVLRKTTKDMELNGFLIPKGWRIYVYTREINYNL RLYPDDPLAFNPWRWLDKSVECQNYNLIFGGGTRQCPGKELGIAEIST FLHYFVTRYRWEEIGGDKLMKFPRVEAPNGLHIRVSPQC |
| 290 | MSAEKERESHVFMAKLAEQAERYDEMVQSMKDVAKLDLELSVEERNL LSVGYKNVIGARRASWRIMSSIEQKEEAKGNEQNAKRIRDYRQKVED ELCRICNDILSIIDDHLLPSSTSGESTVFYYKMKGDYYRYLAEFKSG NERKEIADQSLKAYEAASNTAATDLPPTHPIRLGLALNFSVFYYEIQ NSPERACHLAKQAFDEAIAELDTLSEESYKDSTLIMQLLRDNLTLWS SDLEDLGGDDQPKGEEAKVEDGEP |
| 291 | MSARRRTLLKVIILGDSGVGKTSLMNQYVNKKFSNQYKATIGADFLT KEVQFEDRLFTLQERFQSLGVAFYRGADCCVLVYDVNLKSFDNLNN WRDEFLIQASPSDPENFPFWLGNKIDVDGGNSRVVSEKKARAWCASK GNIPYFETSAKEGFNVEAAFQCIAKNALKNEPEEEIYLPDTIDVNAG RPQRTSGCDC |
| 292 | MSARRRTLLKVIILGDSGVGKTSLMNQYVNKKFSNQYKATIGADFLT KEVQFEDRLFTLQIWDTAGQERFQSLGVAFYRGADCCVLVYDVNVLK SFDNLNNWRDEFLIQASPSDPENFPPFVVLGNKIDVDGGNSRWSEKKA RAWCASKGNIPYFETSAKEGFNVEAAFQCIAKNALKNEPEEEIYLPD TIDVNAGRPQRTSGCDC |
| 293 | MKRASYGCISDEALECVMGHLEDPRDRGSVSLVCKKWYDVDAFTRKH VTVAFCYSIHASDLTRRFTRLESLTVKGKPRAAMYNLLPHDWGGYAK PWIDQISFTCLCLKALHLRRMIVTDDDLTTLVRGRGHMLQELKLEKC |
| | SGFSTRGLEEVAHGCRSLKILMLDESQIEEESGDWLHELALNNSSLE VLDFYMTTLEMINTSDLELIVTNCPSLTSLKVGECDIVEMRGVLSKA TALEEFGGGTFNNSEEHATETSMITFPPKLTSLLGLNFMIEAEMPAI FPPRASALKRLDLQYTFLSTENHCQLAGLCPNLEILEVRNVIGDKGLE VVANTCKKLKRLRVERGADDPTLEDEQDKEEHIADLPLDNGVRALLR GCQKLSRFAFYIRPGGLTDTGLGYIGEYSTNVRWMLLGFVGETDQGI LEFSKGCPKLERLEIRGCGFSESALAAAVLQLKSLKYIWVQGYNATV TGANLLAMARPYWNIEFSPALQSSDVFAEDMAEEKKQDQVAQLLAYY SLAGRRTDHPESVIPLAPLFWNCHQVTVF |
| 294 | MKRASYGCISDGCISDEALECVMGHLEDPRDRGSVSLVCKKWYDVDA FTRKHVTVAFCYSIHASDLTRRFTRLESLTVKGKPRAAMYNLLPHDW GGYAKPWIDQISFTCLCLKALHLRRMIVTDDDLTTLVRGRGHMLQEL KLEKCSGFSTRGLEEVAHGCRSLKILMLDESQIEEESGDWLHELALN NSSLEVLDFYMTTLEMINTSDLELIVTNCPSLTSLKVGECDIVEMRG VLSKATALEEFGGGTFNNSEEHATETSMITFPPKLTSLLGLNFMIEA EMPAIFPRASALKRLDLDYTFLSTENHCQLAGLCPNLEILEVRNVIG DKGLEWANTCKKLKRLRVERGADDPTLEDEQGWISHKGLSLVAQGCP LLEYIAVVYSDICNSTLETFGQCCKNLKDFRLVLLDKEEHIADLPLD NGVRALLRGCQKLSRFAFYIRPGGLTDTGLGYIGEYSTNVRWMLLGF VGETDQGILEFSKGCPKLERLEIRGCCFSESALAIAAVLQLKSLKYI WVQGYNATVTGANLLAMARPYWNIEFSPALQSSDVFAEDMAEEKKQD QVAQLLAYYSLAGRRTDHPESVIPLAPLFWNCHQVTVF |
| 295 | MFTISTCTTHAQSLIYSFVARGTWLAEYTEFKGNFTGIAAQCLQKLP ASNNKFTYNCDNHTFNYLVEDGFAYCWADESVGRDVPMAFLERVKED FKRRYGGGRADTAVANSLNRDFGSKLKEHMQYCIDHPEEISKLAKVK AQVSEVKGVMMDNIEKVLDRGEKIELLVDKTENLRFQAQDFQKKGTE LRRKMWFQNMKVKLIVLGIWALILIIVLSVCHGFNCSKK |
| 296 | MTTEKERENHVYMAKLAEQAERYDEMVDSMKKVAKLDVELTVEERNL LSVGYKNVIGARRASWRIMSSIEQKEEGKGNDVNAKRIKDYRHKVET ELSRICGDILTIIDEHLIPSSSSGESMVFYYKMKGDYYRYLAEFKSG SDRKETADQALKAYLAASTTATTDLPPTHPIRLGLILNFSVFYYEIL NSPERACHLAKQAFDEAIAELDSLSEESYKDSTLIMQLLRDNLTLWT SDLQEDGGEEQLKGEEIKPEDGEH |
| 297 | MSSRERKARVGLKLPIPAREDAFAKPMPLPLPLPKPPNMNGACKLPC VPLEEVTLEDLQKISTLGCGSSKVYKVKHAKTGKIYALKIIQEKHE LAVRKQIMREMEILRRANSPHIVQCYGIFDRGGEISFVLEYMDGGTL AQVLQAHKKIPEHYLAEVARQVLKGLHYLHQNKIVHRKIKPSNLINK REEVKIADFGVSTVLAHTLAQCNSFVGTCAYMSPERFPDPDGYGGKYD GCSADIWSLGLSLLECALGRFPCLSPGQRPDWPTLMVAICLGDPPSP PPDASPEFQSFIRCCLQKDALLRHTALRLLSHPFLKKYEQQSCDLAP LLQSLHL |
| 298 | METTGTNNMQAKLVLLGDMGTGKSSLVLRFVKGQFLDYQESTIGAAF FSQTLAVNEVTVKFEIWDTAGQERYHSLAPMYYRGAAAAIIVYDITN LDSFVRAKNWVLELQKQGNPNLVMALAGNKADMAAKRKVEPEEAETY AKENGLFFMETSAKTAQNVNELFYEIARRLPKARPAGMVLTDR PAESAKTYSCCS |
| 299 | METGAAAVDGHIQGILTHGGQYVQYNIFGNLFEVFSKYIPPIRPIGR GAYGIVCSAVNSETNEEVAIKKIGNAFDNRIDAKRTLREIKLLCHME HENIIAIKDIIRPPQREIFNDVYIVYELMDTDLYQIIRSTQPLTEDH GQYFLYQLLRGLKYIHSANILHRDLKPSNLLLNANCDLKICDFGLAR TTSETDFMTEYVVTRWYRAPELLLNCSEYTAAIDIWSVGCIFMEILK REPLFPGKDYVQQLRLITELIGSPDDSDLGFLRSDNARRYIRQLPQF PKQPFSQKFPNMAPAAVDLLEKMLVFDPSKRITVQEALSHPYLASLH DINDEPSCPTPFNFDFEQPSFTEEHIKELIWRESLNFNPDMMQ |
| 300 | MRVTEQPEDYLFKIVLIGDSAVGKSNLLARYARNEFYPNSKSTIGVE FQTQTMEIDGKEIKAQIWDTAGQERFRAVTSAYYRGAVGALWYDISR RQTFDNISRWLDELHTHSDMNVVTVIVGNKTDLMDAREVSTEEGAAL AEAQNLYFVETSALDSTNVQVAFQTWKEIYNILSRKVLSCQEQKLES KLTNGKTVILHEAESESTTKQTGKFWCCSG |
| 301 | MMSYAGEEQPEDYLFKIVLIGDSAVGKSNLLARYARNEFYPNSKSTI GVEFQTQTMEIDGKEIKAQIWDTAGQERFRAVTSAYYRGAVGALVVY DISRRQTFDNISRWLDELHTHSDMNVVTVIVGNKTDLMDAREVSTEE GAALAEAQNLYFVETSALDSTNVQVAFQTWKEIYNILSRKVLSCQEQ KLESKLTNGKTVILHEAESESTTKQTGKFWCCSG |

TABLE 3-continued

Cell Signaling Protein Sequences

| SEQ ID NO | Sequence |
|---|---|
| 302 | MATRKRTLLKVIILGDSGVGKTSLMNQYVNKKFSNQYKATIGADFLT KEVQVEDRLVTMQIWDTAGQERFQSLGVAFYRGADCCVLWDVNVIKS FDNLDNWHQEFLIQANPNDPDNFPPFWLGNKTDVDGGHSRWSEKKAKM WCAAKGNIPYFETSAKEDMNVEEAFQCIAKNALKNEPDEEIYLPETI DVGHIGVQRPSACQC |
| 303 | MATRKRTLLKVIILGDSGVGKTSLMNQYVNKKFSNQYKATIGADFLT KEVQVEDRLVTMQIWDTAGQERFQSLGVAFYRGADCCVLVYDVNVIK SFDNLDNWRQEFLIQANPNDPDNFPPFWLGNKTDVDGGHSRWSEKKAK MWCAAKGNIPYFETSAKEDMNVEEAFQCIAKNALKNEPDEEIYLPET IDVGHIGVQRPSACQC |
| 304 | MVLRISELTIGYVYTGLKLKEAWIMATRKRTLLKVIILGDSGVGKTS LMNQYVNKKFSNQYKATIGADFLTKEVQVEDRLVTMQIWDTAGQERF QSLGVAFYRGADCCVLVYDVNVIKSFDNLDNWRQEFLIQANPNDPDN FPPFWLGNKTDVDGGHSRWSEKKAKMWCAAKGNIPYFETSAKEDMNVE EAFQCIAKNALKNEPDEEIYLPETIDVGHIGVQRPSACQC |
| 305 | MGQGASSSSWHALKREENDVNLGRDYSLSLPDECLACIFCTLSSGDR QRCSLVCKRWFLVEGSSRQRLSLDARLDISAAIPGLFSRFDHVTKLA LRCDRRMVSIKDEGLIKIGIHCKSLKKLKLKACRELSDVGIEDFAKL CTGLKKLSCGSCTFGAKGMNAVLKYCVGLEELSVKRLRGLADGSVDV IGPGCAMLKSICLKELFNGQYFGPLIAGSKNLRTLKLFRCSGDWDKL LEVITDHVSGLVEVHLERLQVSDRGLMAVSRCAGLEVLHLVKTPECT NVGLAAIANNCKNLRKLHIDGWKTNRIGDEGLIAVGKKCQNLQELVL IGLNLTATSLSPLASNCQVLERLALCGSETIGDTEISCIAAKCLSLK KLCIKGCPVSDDGIESLVSGCPKLVKVKVKKCRGVTWEGAERLRANR GSLAVNLDTPLPNPWGPPSGAGAAEEASAPSTKSSSIAKAKFSLFAGR NLVACAFLRLSNGSDGDHKRVSANA |
| 306 | MAYKVDDDYDYLFKWLIGDSGVGKSNLLSRFTRNEFSLESKSTIGVE FATRSINVDGKMIKAQIWDTAGQERYRAITSAYYRGAVGALLVYDIT RHVTFENVERWLKELRDHTEHNIWMLVGNKSDLRHLRAVSTEDAQTF AEREGLYFIETSALESTNVENAFKQVLTQIYRIVSKKALDVSEDNAA APAQGQTINVKDDVTATKKVGCCSTS |
| 307 | MSSDKERENHVYMAKLAEQAERYDEMVEAMKRVAKLDVELTVEERNL LSVGYKNVIGARRASWRIMSSIEQKEDAKGNDHNVKRIKEYRQKVEA ELSKICHDIMTIIDEHLIPSSNIGESTVFYYKMKGDYYRYLAEFKTG NERKEAADQSLKAYQTASSTAESDLAPTHPIRLGLALNFSVFYYEIM NSPERACHLAKQAFDEAIAELDTLSEESYKDSTLIMQLLRDNLTLWT SDLQEDGVEDQTKGDEPWGMDEEL |
| 308 | MSSDKERENHVYMAKLAEQAERYDEMVEAMKRVAKLDVELTVEERNL LSVGYKNVIGARRASWRIMSSIEQKEDAKGNDHNVKRIKEYRQKVEA ELSKICHDIMTIIDEHLIPSSNIGESTVFYYKMKGDYYRYLAEFKTG NERKEAADQSLKAYQTASSTAESDLAPTHPIRLGLALNFSVFYYEIM NSPERACHLAKQAFDEAIAELDTLSEESYKDSTLIMQLLRDNLTLWT SDLQEDGVEDQTKGDEPWGMDEEL |
| 309 | MVESSREENVYMAKLAEQAERYEEMVEFMEKVTKGVEVEELTVEERN LLSVAYKNVIGARRASWRIISSIEQKEESRGNDEHVVTIREYRAKVE AELSKICEGILRLLDSHLIPSSTAAESKVFYLKMKGDYHRYLAEFKT GAERKEAAENTLLAYKSAQDIAAAELAPTHPIRLGLALNFSVFYYEI LNSPDRACNLAKQAFDEAIAELDTLGEDSYKDSTLIMQLLRDNLTLW TSDMQEDAGEEIKETSKREDGEEQ |
| 310 | MDGMSTRGGSNFDMYLPNYKLGKTLGIGSFGKVKIAEHALTGHKVAI KILNRRKIRNMDMEEKVRREIKILRLFMHPHIIRLYEVIETPSDIYV VMEYVKSGDLFDYIVEKGRLQEDEARCFFQQIIGAVEYCHRNMVHR DLKPENLLLDSKCNVKIADFGLSNVMRDGHFLKTSCGSPNYAAPEVI SGKLYAGPEVDVWSCGVILYALLCGSLPFDDENIPNLFKKIKGGIYT LPSHLSSGARDLIPRMLWDPMKRMTIPEIRQHPWFLEKLPRYLAVPP PDTIQQAKKIDEEILQEVIKRNFDRNQLVESLRSRIQNEATVAYYLM LDNRSRISNGYLGSEFQEAKDCIHHFVPTDRATPTDGHRLTGFINQG NASRSQFPIERKWALGLQSQAHPREIMSEVLKALQELDVAWKKIGHY NMKCRWFPAVLRKVDSSMNKSLHGNHIIQDDSTAGINCRSPPNWKFE VQLLYKAREEKYLLDLQRVQGPHFLFLDLCADFLAQLRVL |
| 311 | MTIARRCSSLIVRGVRSAGSRSSAVGSPALSKQASTKNSRIQRFGTA ASALEEPIAPPVQVKYTHLLIDGQFVNAASGKTFPTFDPRTGDLIAD VAEGDAEDVDRAVKAARKAFDEGPWPKMTAYERSCIMYRFADLLEKH NDEIAALETWDNGKPYEQSSLVEVPMAIRVFRYYAGWADKIHGLTIP ADGPYHVQTLHEPIGVAGQIIPWNFPLLLFSWKVAPALACGNTIVLK SAEQTSLTAIYAAKLFHEAGLPSGVLNIIPGYGRTAGVAIAKHMDID KLAFTGSTETGKAVLELASKSNLKRVTLELGGKSPFIVCEDADVDQA VELAHSALFFNQGQCCCAASRTYVHESIYDEFVEKTKARCLSRWGDP FKKGVEQGPQIDQMQFNKIMSYIKAGKESGAKLVTGGEQIGTKGFYI MPTVFSEVQDDMPIATDEIFGPIQSILKFKDINEVIKRANGTDYGLA AGVFTKSMDTANTLTRALRAGSIWINCFHIFDAGVPFGGYKMSGTGR QKGIYGLQSYLQVKAVVTPLKNPAWL |
| 312 | MAAMRAGRGFSSLLTRAVRSAGTRSPAVGLAALSQEASIKNTGIRSL GTAASALEEPIAPPVQVQYTQLLIDGQFVNAASGRTFPTLDPRTGDL IVDVAEGDAEDVDRAVKAARKAFDEGPWPKMTAYERSCIMLRFADLL EKHNDEIAALETWDNGKPYEQAALVEVPMWRLFRYYAGWADKIHGLT VPADGPYHCQTLHEPIGVAGQIIPWNFPLLMFAWKVGPALACGNSIV LKSAEQTPLTALYAAKLFHEAGLPPGVLNVISGYGPTAGAAIARHMD IDKVAFTGSTSTGQAVLELASKSNLKPVTLELGGKSPFIVCKDADVD QAVELAHFALFFNQGQCCCAGSRTFVHESIHDEFVEKAKARCLSRWG DPFRKGVEQGPQIDREQFNKVMGYIKSGRESGAKLVTGGDQIGTKGF YIMPTISFEVKDDMGIATDEIFGPVQSIMKFKTLDEVIKRANATRYG LAAGVFTKNIETANSLTRALRVGTWVVNCFDIFDAGIPFGGYKMSGT GREKGIYSLNNYLQVKAWSPLKNPAWL |
| 313 | MKRQHFQLQQQQQPQPNGHGRCCSTVPVHPNPVSMPGSGPPPQAPRT TATAPAAGAAAAGGGGSSGSCKGKEWLKDTCKQGVGVDMELASMGYS VKSSELEQVAHRLEQLEMMMCNGQEDGIISHLSSEAVHYNPSDLGGW IESMLSELHVPILPPTDQPFQFPQAAADQSSTVREASNSVPESSTST SKGTRSVQNVEQDQQYRLNGSGAGLFEPPEVLDRSEFQLHGYPGQGG VRDNGIDRMFGNYGGLFSQVLDVSDLLVDDPDVLQEPPPQEASPSTL LLQQSSSNSSLEVQSGQDRLEEDVTGREQKRYRVCDPELSERTVVMG ADPHESGVRLVHTLMACAEAVQRGNLAIAREMVKEVRILASAQGGAM SKVATYFAEALARRIYGFLPQDTLRFNQNDPLSDFLQIHFYQTCPYL KFAHFIANQAILDAFSGHQQVHVIDFNLKQGIQWPALIQALALRPGG PPAFRLTGIGPPQPDGTDALQEVGTRLHQFAESVNVKFSFRGYVATS LADIKPWMLDARPELEAVAVNSILELHRLLEDPIPGRPSAIDRVLAS IWSLKPKILTVVEQEADHNRPVFLDRFTEALHYYSTVPDSLEARGLQ AQSEEQVMSEVYLGREICNIVACERSERVERHEPLLNWSVRLRNAGF WPIPLGSNAFKQASMLLSLFSGGEGYRVEENNGCLTLGWHSRPLIAA SAWQRC |
| 314 | MAYSGRARRPISFLLKQLKTSHSYSSWTRCNGFNGQSMFQSNAISRC KAPSFRPTAELGWVLGFSHSCRGYSAEVGSTEQVGLIKQLRERTSAP MKDVKAALVDCNWDLEAAYTELRKKGIAGASKKGARIAAEGILALAQ DEKVAAVIELNCETDFVARNEIFQYLAHSVAKSALTMEALPELLSES ATLDLKLLGEMNIILDHPKLTREITVQDAIMEVAAIMGENVKLRRGF ALSSSANGWSSYLHTSPQPGLGRIAGLLTLESENGGAPTEVLQRVGSN LAMHWAARPLFLSKDHVATKTLEAERDILKTQAAASGKPQAAIEKMV EGGQLRKFVEEIALLEQKFVMNDKVNVKSVLEDLSKEVGQQIRVGSFL RVEVGEGIHRQETSFASEVAAQVG |
| 315 | MEASAAAADGHIQGILTHGGRYVQYNIFGNLFEVSSKYVPPIRLGIQ GAYGIVCAAVNSETNEQVAIKKIGNSFANRIDAKRTLREIKLLCHMD HENIIAIKDVIRPPQRENFKDVYIVYELMDTDLCQIIHSKQPLSVDH CQYFIYQLLRGLKYIHSANILHRDLKPGNLFLNEDCDLKIGDFGLAR TTSDTDSMTEYVVTRWYRAPELLLNCSEYTAAIDIWSVGCIFMEILK REPLFPGSNYVEQLKLITEFIGSPDDSDLGFLRSDNTRRYIRQLPQV PKQPFAQKFPNMDEDALDLLEKMLVFDPSKRITVEEALSHRYLASLH GINEEPRCPAPFNFDFEQGTFTEEHIKELIWRESLNFNPDMME |
| 316 | MAVPVIDMKKMLNGEEREVTMAKIQNACQEWGFFQLLNHGIPHALLD RVKELFKEHYKNSMDAEFQKSEIVGMLESAVSQGKNFGTTKIDDDWE TGFFLQDETYDTVSPPLPTNLKETMKEFSEEVKILAERILDIICENL GLEKGYLKEAIAGGNGDGKAPFFGIKMAHYPPCPRPELVDGLRPHLD AGGVILLLQDDEVGGLQVLKDGTWFDVEPIRHAIVIDIGDQLEVMTN GKCKSMWHRVLSKKDANRMSVAAFYNPSTNAEVFPAPQLIMKATEQN GNENDNNNMNAQSGYSYPKFVSKDYMKVYGEQKFLEREPRFEAMRAL CSLK |
| 317 | MPAKNGASLSSPFNIFFMSITGTAMKKMLNGEEREVTMAKIQNACQE WGFFQLLNHGIPHALLDRVKELFKEHYKNSMDAEFQKSEIVGMLESA TKIDDDWETGFFLQDETYDTVSPPLPTNLKETMKEFSEEVKILAERI LDIICENLGLEKGYLKEAIAGGNGDGKAPFFGIKMAHYPPCPRPELV DGLRPHLDAGGVILLLQDDEVGGLQVLKDGTWFDVEPIRHAIVIDIG DQLEVMTNGKCKSMWHRVLSKTDANRMSVAAFYNPSTNAEVFPAPQL |

TABLE 3-continued
Cell Signaling Protein Sequences

SEQ
ID
NO Sequence

ILKATEQNGNGNDNNNMNAQSGYSYPKFVSKDYMKVYGEQKFLEREP
RFEAMRALCSLK

318 MASPYGDYDQRIDYMFKVVVIGDSAVGKSQILSRFAKNEFSLDSKST
IGVEFQTRTVAIDNKTIKTQIWDTAGQERYRAVTSAYYRGALGAMLV
YDITKRQSFDHVARWLEELRGHADNNIVIMLIGNKCDLRDMRAVPEE
DAKEFAQREGLYFFETSALEAINVEMAFITALTEIYRIVSRKALTAN
EDERNGNAAALTGTKISLSSPEQSVMAVKKKSCC

319 MDRLISGQTTCNSVEKQSNGDSNLDYSVSDAVRDKLRLMRDRIEKED
PASKVTDDGTLLRFLYARESNVEKACEMFAKYRKWRQTYVPLGYIPE
TMVGNELKHKFVYMQGYDKVGRPIMVLRLARHIASQSNMEDFKRFVV
YAFDKMSASATKGQTKFSIIADFADWAYKNVNLRGTIAAVQTLQDFY
PERLGKVYLINRPYIFWAAWKIVSPFIDKVTRQKIVFTDDKYVKETL
LKDIDENQLPEIYGGKLPLVAIDDCWPNWPPITSF

320 MTEKERENHVYMAKLAEQAERYDEMVDSMKKVAKLDVELTVEERNLL
SVGYKNVIGARRASWRIMSSIEQKEEAKGNELNVKRIKEYRHKVEDE
LSRICNDILTIIDEHLIPSSSTGESTVFYYKMKGDYYRYLAEFKTGN
ERKEAADQSLKAYQAASNTATTDLAPTHPIRLGLALNFSVFYYEILN
SPERACHLAKQAFDEAIAELDTLSEESYKDSTLIMQLLRDNLTLWTS
DLQEEGGEDQPKGEEDKIEEIEH

321 MVKLTMIARVTDGLPLAEGLDDGREQRDLEFYKQQAKALFKKLSHGQ
HEPSRMSIETGPFIFHYIIEARVCYLTMCDRSYPKKLAFQYLEELKN
EFEKLYQSQVETVARPYAFIKFDTFIQKTRKLYLDTRTQRNLAKLND
DLYEVQQIMTRNVQEVLGVGEKLDQVSQMSSRLSSESRKYADKAKDL
SRQAFIKKWAPVAIVLGVVFVLLWMRWYIWQ

322 MARRTDDEYDYLFKWLIGDSGVGKSNLLSRFTRNEFCLESKSTIGVE
FATRTVQVEGKTIKAQIWDTAGQERYRAITSAYYRGAVGALLVYDIT
KPTTFENVGRWLKELRDHADSNIVIMLVGNKSDLKHLRGVSTEDAQS
FAEKEGLSPLETSALEATNVERAPQTILAEIHRIISKKALASEEAAG
AGIREGKTILVSEPDSNTKKACCS

323 MDQDQSICRFAAQKGKGEIQSSSFPDEVLEHVLVFLSSQKDRNSVSL
VCKAWHRVEAWTRQQVFIGNCYAVSPQIMIKRFPKIKSVSLKGKPRF
ADFNLVPPNWGAHLTPWVSAMATAYPLLERLYLKRMTITDYDLTLLA
NSFLYFKELVMVCCDGFSTGGLASIASKCRQLTTLDLNEDEIHDNGE
DWLACFPETLTSLRSLCFDCLEGPVNFDALERLVARCPSLKKLRLNR
NVSIVQLQRLIIKAPQLTHLGTGSFFYEFQLEQVADLLAAFSNCKQL
QCLSGFREWPEYLPAVYPVCSNLTSLNFSYAVIGSRELEGIVCHCRK
LQLLWVLDSVGDKGLEAAATTCKDLRLRVFPVDAREDGEGCVSERG
LVAISEGCPNLESILYFCQRMTNKAVVTMSHNCSKLASFRLCIMGRH
QPDHLTGEPMDEGFGAIVRNCKSLTRLAVSGLLTDKAFQYFGAYGER
LETLSVAFAGESDLSMKYVLDGCKNLRKLEIRDSPFGDVALLSGLHH
YENMRFLWMSDCRLTLQGCTELAKKMPGLNVEIIRENECNDSLVEKL
YAYRTVAGPRKDMPSFVTIL

324 MQQDQRRKNSSEIEFFTEYGGASRYKIQEVIGKGSYGWCSAIDTHTG
EKVAIKKITNIFEHLSDATRILREIKLLRLLRHPDIVEIKHIMLPPS
QREFKDIYVFELMESDLHQVIKANDDLTPEHYQFFLYQLLRALKYI
HTANVFHRDLKPKNVLANADCKLKICDFGLARVAFNDTPTAIFWTDY
VATRWYRAPELCGSFFSKYTPAIDIWSIGCIFAEVLTGKPLFPGKNW
HQLDLMTDLLGTPSPETIARVRNEKARRYLNSMRKKQPVPFTQKFVG
ADHLALKLLERLLAFDPKDRPTAEEALADPYFRGLAKVAREPVAQPI
TKMEFEFERRRVTKDDVRELIYREILEYHPQIMKEYLNGTDRTNFMY
PSAVDQFKRQFAHLEEHYGKGGSVPPLERQHASLPRPCVVYSNSGGP
SSEQASSGPSRDRALEVREEAPRYSREGEKQHQDRSSGNVKVPLHAS
HKVLQGSTAKPGKVIGPVLPCENGSIKEAYNPRRLIRNAGVAPSQCP
APIYSYPRRNSTAKTEVDDKREDGINQFNVSQHKTQYVGIGAARKVA
ALESRSSHLY

325 MADDLGEFYVRYYVGHKGKFGHEFLEFEFRPDGKLRYANNSNYKNDT
MIRKEVFLTQAVLRECRRIIAESEIMKEDDNNWPEPDRVGRQELEIV
MGNEHISFTTSKIGSLVDVQSSKDPEGLRIFYYLVQDLKCFVFSLIG
LHFKIKPI

326 MPPTSDRIPAMADDLGEFYVRYYVGHKGKFGHEFLEFEFRPDGKLRY
ANNSNYKNDTMIRKEVFLTQAVLRECRRIIAESEIMKEDDNNWPEPD
RVGRQELEIVMGNEHISFTTSKIGSLVDVQSSKDPEGLRIFYYLVQD
LKCFVFSLIGLHFKIKPI

327 MGHNTSEAIKQMTAFIDGVDEPLKKSFQTMHRGYAQQTLERFLKARE
GNVQKANKMLLDCLSWRVQNHIDNILAKPIEPREVYNAVRESQLMGM
TGYCKKGRPVFAIGVGLSGYDKASADKYVQSHIQINEYRTKFSLPNA
SKKYGSYIGPCLKILDMTGLKLSALNRIKILTTIATVDDLNYPAEXR
STYYIVNAPYVFSACWKWKPLLQEGLDEKLQVLQGCGREELLKVMDY
DVLPHFSRQEGSGSSKHHNGKTIDCFSPDHPFHVELYNYIKQQAAII
KPVAPEKMRSFHVDVPEQDDEGTIIVQTLRICIT

328 MAETVTYSWPVGFVCFVLTMLLLQLYRIVWREDSRGYNLPPGSSGWP
LIGETLSPFMRGINSISKPRQFIQDREQRYGKIFRTNLFGRSRMIVS V
DPEFNKYILQHEGRLVQSSYLRPFRKLIGKYGLLSVYGDLQKKLHGT
AVNFLRPFERLSVHFMEDIQNLMHTTFAQWQAKGHIHLYHECHQFVLN
LMAKQLLDLSPSKETEEIGKAFGDFSKSFWLPIRIPGTAYWKGLKAR
DFLMKKIYASIKYRREHPEWHNDFLGELLKEDLHSEEIIADFVLFLL
FAGHETSASTMAFAIKFLTDCPQALRELKAEHNALLKRKGSPRNQNL
TWDDYQSLKFTQCVINETHRLANVAPAVFREAIADIKIKGFVIPKGW
SVLVLMNGIHLDDKYHSSPLKFDPWRWQQILENNELYKNPSFMPFGG
GLRLCPGMHLAKLELGLFLHHFITKFRWEPLDDDKISYFPVSHLTKG
FPIRLHPQEQMDD

329 MDRLSNGQTTCNSVEKGNDGGLNFDNSISDAVRTKLRQMRDVIEEKED
PSSKVTDDDTLRRFLYARELNVEKASVMFSKYRKWRQTFVPLGYIPE
TMIRDELMKNSVHMQGFDKRGRPIMIAVIFLARHIPCRKTIENLKCHFV
YIFDKMSASSRGQTKFTIIADFDGWTYKNVDIRGAIAVLEILQDYYP
ERLGKVYLIHRPYIFWAAWKIVSPFIDQVTREKIVFVEDKHLNETLL
NDIDESQLPEIYGGKLPLVKIQDCWPNWPPITST

330 MTGVEYDASDKDREPFVEVDPTGRYGRYEDVLGRGAMKTVYRAFDQE
DGIEVAWNKVSLQNLDDVSLERIYSEVRLLKSLRNGNIIMFYNAWLD
RKTGHVNFITEVCTSGTLRQYRQKHRHVSMKAVKNWARQILDGLHYL
HSHIPCIIHRDLNCSNIFVGNNTGILKIGDLGLAAALENDHAAHTII
GTPEFMAPELYEEDYNELVDVGYSFGMCLLEMVTLEIPYSECRSVAQI
YKKVSSGIRPAALEKVTNQEVRQFIEKCLAVTSARPSAAELLKDPFL
SEVQSSS

331 MPYYVLQREVESEFLEVDPTGRYGRYNDVLGKGASKTVYRAFDEIEG
IEVAWNQVKVNDILQSPEDLERLYSEVHLLKTLKHKNIIKFFSSWID
TTTTRNINFITEMFTSGTLRQYRQKHKRVDLRAVKNWARQILRGLLYL
HSHDPPIIHRDLKCSNIFVNGNQGEVKIGDLGLAAILRKSHSAHTVI
GTPEFMAPELYDEEYNELVDIYAFGMCLLEMLTFEYPYSECSNPAQI
YKKVTSGKKPAALYKLKDPEVRQFVEKCLVTVSRRLPARELLMDPFL
QTDEHGLEYSFSRLDFCKDDVGELGPLLREPNIEAFQNGAHKLLQSI
HLVHPCSKNEISVHHENKKQQKWPLPSYIREDSMSHNMDFTVKGKKR
EDDTIFLRLRIADTEGRIRNIYFPPFDVEEDTAMSVASEMVAELDLAD
QDVTKIAEMIDEEIMALVPDWKAGVAIDDDHHSFYDHYHSSNKTSETC
WWNHNDHASSISSQSSLLEYLRSHYHVDNKSEIVPCTQVECAAMHGR
FEEVTFQFNATDFYSYVEEEAPTISSGSSDVLHHDWVNGEDPVSPIS
LISHGSGISNFEDPQTCLISSGTGNKEDWPSKPAKPPETTGYVGNFE
ESWSNGLSEGFSPVTDSNCLSSVPKPMFHPQSPSSVNILSDEDEDST
SRELRLLAVKHQKELMELQRKHEHSLLGIENELKNRTPLGTSLDMKN
SSPGINFDQKLNVNGQREQREDDSVRHGTTGRDKEFVAMKQLGSDA
RGTRLSSSPSHRLSPMEPAVSSDLPGPSKLAMHSSTLPSVRPINRNI
APNQRLMKMHSFSGVDSQRSINSLAKEVSRQKNYQTIGAFRTGNVDE
KKHSLEGMRRFPSISQKSSSRNCKEGKTKIV

332 MGSGIMTETLTDSWLVGLLCLVLGFLLLQLYKLVWGASSRAYKLPPG
STGWPLIGETIGFFRGINSTAQPRQFIQERERRYGEIFRSNLFGRSR
IWSVDPEFNKHVLQHEGRQFQANYPKPLRNLIGKYGLLSVHGDLQRK
LHGAAVNLLRFERLSVDFMEDIQNLLHITLAKWEAKRDIHLQEECHQ
LVLNLMAKQLLDLSPSKDTEEICEAFGHFSEALLAVPIKIKPGTKYAR
GFKAREFLIKKIYESIEDRRQHPEAVHNDLLTKLLKEDTFSEEIIAD
FILFLLFAGHETSSRSMSFAIKFLTDCPRALEELKAEHDALLMRKGN
LKNQKLNWDDYQSLKFTQCVIHETLRVGNFGPGVFRETKEDIKTKGG
FVIPRGWTVYVFLTGTHLDEKYHSSALKFDPWRWQPHLQDQELLKNP
SFMPFGGGARLCPGMHLAKMELALFLHNFVTKFRWEALQDDKISYFP
FPRLIKGLPIRLRLRE

333 MAIMGETLHSLLVGLVCFALGMLLLELYKLVWRVDSRSYKLPPGSTG
LPLIGETISFFRGINSTDQPRRYIQEREKRYGEIFRSNLFGRSRIWS
VNPEFNKHVLQHEGRQFQANYPKPLRNIGKFGLLAVHGDLQKKLHG
TAVNLLRFERLSVDFMTDIQNLLHTTLPKWQAKRDIHLQEECHQLVL
NLMAKQLMDLSPSKETEEICEAFGHFSEALLAIPLRIPGTAYARGFK
AREFLIKRIYEGIEDRRKHPQWRNDLLTKLLKEDSFSEELIADFILF

TABLE 3-continued

Cell Signaling Protein Sequences

| SEQ ID NO | Sequence |
|---|---|
| | LLFAGHETSSRSMSFAIKFLTDCPKAYQELKAEHDALLQRKGNRRNG NLTWDDYQSMKFTQCIINETLRLGNFAPGAFREAKEDVKTKGGFVIP KGWTVYVFLTGTHLDEKYHSSALTFNPWRWQQLLQDQELSKNPSFMP FGGGARLCPGMHLAKLELALFLHNFVTKFRWEALQDEKISYFPFPRL IKGLPIRLHPQERLGD |
| 334 | MGGTVVDSVRRWYQRRWSHSSSAHESGKEKQTVDSLSSSSVSPLPVE TKAVEGRGLKPVRVQLRSKMTGPDRSRKSSLETEFFTEYGEANRYQI QEWGKGSYGWSSAIDTHTDIVEIKHIMLPPSRREFKDIYVVFELMES DLHQVIKANDDLTPEHYQFFLYQLLRALKYIHTANVFHRDLKPKNIL ANADCKLKICDFGLARVSFNDAPSAIFWTDYVATRWYRAPELCGSFF TKYTPAIDIWSIGCIFAEMLTGKALFPGKNWHQLDIMTDLLGTPSTE TLSRIRNEKARRYLSNMRKKQPTPFSQKFPNVDPLALRLLERMLAFD PKDRPTAEEALADPYFNGLAKVEREPSTQPISKLEFEFERRRLTKDD VRELIYREILEYHPQMLQEYLCGGNNATFMYPSAVDMFKRQFAHLEE HYSKGENSTPLGRQHASLPRERVIEFRENPTKHSKDSEKQQERITAS VTKATLQSPPRNQGIVIDSAVSLSNGPSRAVPDPRNLVKSASINASK CTVVVNSCQRRNSTMKPGDEKKEDLSSESSAVTYNTDSMVAGLTSKI AAMSSGVAHS |
| 335 | MAYRADDDYDYLFKWLIGDSGVGKSNLLSRFTRNEFSLESKSTIGVE FATRSIITVDDKVIKAQIWDTAGQERYRAITSAYYRGAVGALLVYDVT RHVTFENVERWLKELRDHTDANIVIMLVGNKADLRHLRAVSIEDGKA FAERENTYFMETSALESTNVENAFTEVLSQIYRIVSKKALDVGEDPA AVPSKGQTIHVGNKDDVTAMKKVGCCSL |
| 336 | MMKKRGDSSSSFPDEVLEHVLLFWSIKDRSAVSLVCKAWYRAEAWSR RKVFIGNCYSVSPEILVRRFPKITGITLKGKPRFSDFNLVPPHWGAD IHPWLLVIRGAYPWLRELRLKRMIVTDESLELIARSFSDFRALSLTT CEGFSTDGLAVIATHCRNLQELDLQESEVDDRGGYWLSCFPESCVSL VSLNFACLQSEVNFDALQRLVARCISLRSLKLNKTLSLEQLKRLLVI APQLMELGTGSFFQELSGPQFTTDLENAFKNCNKLRTLSGMWEVAPL YLPALYSVCSNLTFLNLSYAANIRSMELGRLVSHCPQLRRLVVVLDT VGDKGLETVSSNCKNLRELRVFPLDPFGQDRVGVTEKGILKISQGCP NLSYVLYFCRQMTNAAIIEVAQNCPRLTHFRLCIMNPCQPDHLTDEP MDEAFGAIVKICKGLQRLAISGLLTDKAFEYIGLYAKNLETLSVAFA GSSDLGMECVLRGCPKLRKLEIRDSPFGNAALLSGLEQYESMRSLWM SSCKVTMSGCRYLAQNKPRLNVEIIKENDEDDNDADKLYVYRTIAGP RRDAPNFVLTL |
| 337 | MVDHSLIYSFVSRGTVILAEYTEFTGNFPTIAFQCLQKLPATSNKFT FDCQHHTFNYLVEDGFTYCWADESAGRQVPMAFLERIKDEFKKTYSD GRAEVAIANGLHQEFGPKLKEHMDYCAQHPEQINKLAKTKAQVAEVK GVMMDNIEKILDRGEKIELMVDKTEQLQFQAQDFQNQGAKIRRKMWF RNTKVKLICLSFLLFWLMIWISLCRGFKCHV |
| 338 | MAILYALVARGSTVLAEFDAAHGNAKTIARQILEKIPGTGDSHVSYS QDRYIFHVKRTDGLTVLCMADDTAGRRIPFAFLEDIHGKFVKTYGRA VHTALAFTMNDEFSRVLSQQMEYYSSDPNADKINRIRGEMSQVRNVM VENIDKVLERGDRLELLVDKTETIQGNTFKFKKQARRFKNTMWWRNI KLTVAVIWLLIVIYVILAIVCKGVTLPSCRK |
| 339 | MAWASNSLQLQREEEAETMISDQQQEAGAEIMASEEESIMEPENPSL SHPNIVSSCGMRFQKYQSVWIDANLVPAVNFIQNEFQPRPDDIFFAS LPKTGTTWGKALLYTILEFTSTGNNPPASPNGNSAADEKRFGVDEKN PHALVPTMETYLFNSSDSEQYDISCFDFPSPRVLHFHDPIIHTLPPL VRSSPTCKIVYIARNPRDSFVSLWQFYARLRGAGSHYLDGDLGKETV FDAFCSGFYYGGPFAENVLSYWHESRRNPNQVMFVTYEDLQADCVGW VKRMALFLGCSSPLLEDNAQIIAEKCSFDTLCNLQVNRKGKVGTLKY GMKNAFFFREGKVGEWKKHFTPQMEERIYLEIEQKLSDQGLRFTNSL |
| 340 | MGQQSLIYSFVARGTWLAEYTQFTGNFTTIANQCLQKIPASNNKFTY NCDRHTFNYLVEDGYTYCWADESVGRQLPIAFLERIKDDFKKRYGGG KADTAVAHSLNLKDFGPKLKDHMQYCVDHPEEINKLAKVKAQVSEVKG VMMENIEKVLDRGEKIELLVDKTENLRFQAQDFQKQGTQLRRKMWFQ NMKVKLWLGIVFVLILIIWLSICHGFKCH |
| 341 | MENMRKKLGPLFNSGQSFRPDISVDSCTSYKVTAGGTLHLLSNSCGE YNINELGLQKRTSAGIDHLVHRDIKPANLLINLNGEPKITDFGISVG LENTVAMCGTFVGTVYMSPERIGNEYYSFPADIWSLGLSIFECGTG EFPYNASKGPVNLMLQVIDDPSPSPSRDCFSEEFCSFVDVCLQKDPT ARPTAEQLLSHPFIKKYENAGVDLSAYVQSIFDPIDRLKDLADMLTV HYYMLFDGTDDQWHHMKTMYRENSAFSYANQVAAGANDIFNTLSRIH |
| | SMLVGDSPDERLVHWENLQCCVYGQHGWIRVSGSFVLGGQFIPTGGG VQVEGVSQGPLLDIASQRMGTFNEQFIMEPGEQIGCYYIYKQELCIQ Q |
| 342 | MAQTAQPALDPNIPGVLTHGGRFVQYNIYGNMFEVTAKYVPPLFPIG RGAYGWCSALNSETNEQVALKKISNAFDNLIDARRTLREIKLLRHMQ HENVISIKDIMLPPQREAFDDVYIALELMDTDLHQIIRSNQALSEQH CQYFLYQILRGLKYIHSANVLHRDLKPSNLLLSANCDLKIADFGLAR TTSETDFMTEYVVTRWYRAPELLLNSPDYTAAIDVWSVGCIFMELMN RKPLFPGKDHVHQLRLITELTGTPTPDADLGFIRSENAKRLVQLLPQL PRQSLAEKFPHVHPSAIDICERMLTFDPNQRITVEEALNHPYLGSLH DETDEPTCPVPFNFDFEQYALTEEQMRELIYMEALAFNPT |
| 343 | MKRCEGCFEVGRLEALGDDILLQVLDNINETRDRNSWSLVCKQFYRL ESAYKRKIRLLRGEMLPRILKRYRAVEHLDLSLCPQISDQCLGFVAA AAGSSLRSIDLSRLVRFSHLGLSVLAKGCENLVEIDVSYCARFGDME AAAVSSAKNLQTLKLVRCQMVSDLGLSLIAVGCRKLQNLNLKWCVGV SDLGVELVAIKCKELRSLDVSYLQITNKCIASITQLFYLETFVSVGC VCIDDEGLALLKNGCKSLQRLDVSKCQSMSSTGIISLANGCIALQQL NLAYCIPVTNALLASFDKYDSLQSIRFDGCEISSSGLKSIGKSCKSL MELSLSKCTGVTDEGISALVGGCTGLKILDITCCRDLTDVAITAVAT SCGNLSCLKMESCALVTERSLYMLGDSCPFLEVLDLTDCSVSNTGLK SISRCTGLTTLKLGLCENISNEGLTHIAAHCSNLQEIDLYRSVGIGD TGLAALASGCPKLRMVNLSYCIGITDHGLKSLAQLEKLYNLEIRGCF LVTSAGISAIASGCKRLVELDIKRCYRVDDMGMMTVVQCCINLRQIN VSYCPISDAAFLALVNLSCLQNVNLVHLRNVSLDAFAYLLLACESLK KIKLLKQLKSLLSSNLIRHVENKGCRIRWVEKPLFI |
| 344 | MEAAAAPVQSTDTLMSDAPQAAGSNPMDSIPAVLSHGGRFVQYNIFG NIFEVTAKYKPPLLPIGKGAYGIVCSAMNSETKEQVAIKKIANAFDN RIDAKRTLREIKLLRHMDHENWAIRDIIPPPQREAFDDVYIAYELMD TDLHQIIRSNQGLSEEHCQYFLYQILRGLKYIHSANVLHRDLKPSNL LLNNANCDLKICDFGLARITSETDFMTEYVVTRWYRAPELLLNSADYT AAIDVWSVGCIFMELMNRQPLFPGRDHVHQLRLLTELIGTPTEADLG FVRSDNARRFIRQLPQYPRQSFTQKFPHVHALAIDLCEKMLTFDPNQ RITVEEALAHPYLANLHDISDEPICAMPFSFDFEQHTLTEDQMKELI YREALVFNPEYAQ |
| 345 | MAKKQAGKSNDSTVNDSGSENETKKPAGSKEDGSIHSPLVAYASILS LLSCTPPFVIFLWYTMVHLDGSASQFWDLCKEQGLQGFLRIWPKPTL IAWKLIASFAAFEAALQLLLPGERVTGPVSPAGNIPVYKANGVLAYF VTLTTYIAIWWFGLFNPAIVYDHLGEIFSALIIGSFIFCIFLYIKGH VAPSSTDSGSSGNWIDFYWGMELYPRIGKNFDIKVFTNCRFGMMSWA VLAVRYSIKQYEEYGRVADSMLVSSILMVVYVTKFFLWESGYWNTMD IAHDRAGFYICWGCLVWVPSVYTSPAMYLVRHPISLGLKLSLGILIA GIACIFINYDCDRQRQLFRKTNGNCLIWGRPPSKIEAWYETMSGEKK SSLLLTSGWWSVSRHFHYVPEILAAFFWTLPGLFNHFLPYFYVIFLT ILLFDRAQRDDQRCRAKYGKYWDIYCKQVKYNIIPGIY |
| 346 | MKFPAPARNLLIVLIVFLERILTRCMVSDSSNHEPPSSCTATRISPA SSGIISNTKPADCSSLASLDLHGSISLPGTAITTEDFGGIYHHKPLA IVHPASVEDIVKVVTMVNASPNLTLAAMGNGHSINGQAQALNGLVLD MRSLKGIEIFQGSPTEGPYVDACGDELWIDVLKATLRVGLAPRSWTD YLPLSVGGTLSNGGVSGQTFKFGPQISNVLNLHWSGKGESMTCYPET NQDLFYGALGGLGQFGIITKARIMLQRAPHMVRWIRAVYADFEEFRA DQELLISLPEEGTFDYYKFLTNNDDPINGWPSVLLSPSNSSFDFK LIPQTAGPMLYCLEVALHYDHDEDFVTLNKRIESMLAPLRFIKGLHF SFDLPYFDFLNRVHAAEVAARSSGIWDAPHPWLNLFVPKSKISAFDA KVFREILKDGVGGPILVYPVTRNKWDSRMSAIIPEEDTFYLVALLRF SPPYPSGPPIQSILAQNEQILHYCTTAGIDMKLYLPHYKTESDWKRH FGRKWQQFLQRKSKYDPKAILAPGQRIFSRSTDSTAFTRLYSSS |
| 347 | MAGELTQAEKETLAAVNVGASALSFAGSAFIVLCYVLFRELRKFSFK LIFYLALSDMFCSLFNLIGDPGKGFFCYAQGYTTHFVCVASFLWTTT IAFTLHRTWRHKTDVEELGAIFHLYVWGTSVLVMTIIPSIGDGYGQAG AWCLVKTTSRATKVLQFITFYAPLWGAILFNGFTYFQVSRMLNNATQ MAAGMSDRQQQTDSRVDMKAMNRWGYYPLILIGSWTFATVNRIHDFI EPQEKVFWLSFLDVGTAALMGLFNSIAYGLNASVRRTLQQKIDLWVV PEWFRKWLPGFIMLRDQAHESEMISLKIPVEQ |
| 348 | MAYKADDDYDYLFKVVLIGDSGVGKSNLLSRFTRNEFSLESKSTIGV EFATRSIIVDGKTIKAQIWDTAGQERYRAITSAYYRGAVGALLVYDI TRHTTFESVERWLKELQDHTDNNIWMLVGNKADLRHLRAVSTEDSQA |

TABLE 3-continued

Cell Signaling Protein Sequences

SEQ ID NO | Sequence
---|---

LAERESLYFMETSALESTNVENAFTQVLTQIYRIWKKALDVSEEPSA
LPPQGQAINIKDDVTATKKPMCCNF

349 MESCNCIDPPWSADDLLTKYQYISDFFIALAYFSIPLELIYFVKKSA
VFPYRWVLVQFGAFIVLCGATHMINLWTFHVHTKAVAMVMTISKILT
AWSCATALMLVHIIPDLLSVKTRELFLKNKAAELDREMGIIRTQEET
GRHVRMLTHEIRSTLDRHTILNTTLVELGRTLALEECALWMPTRTGL
ELQLSHTLRQQNPMTFTVPIQHPSINQVFSTNRAVMISPNSPVAMIR
PRTGKYMIGDWAVRVPLLHLSNFQINDWPEPSKRWYALMVLMLPSDS
ARRWHVHELELVEWADQVAVALSHAAILEESMRARDLLMEQNVALEI
ARQEAETAIRARNDFLAVMNHEMRTPMHAIIALSSLLQETELTPEQR
SMVETILRSSNLLATLINDVLDLSKLEDGSLELNIRIFNLRSMFREV
HNLVKPIASVKKLCVSMNLASDLPEYAAGDDKRLMQTVLNVLGNAVK
FSKEGSVSVTVLLERPECLRDPRAEFYPVQGDRHFYLRVQVKDTGAG
INPPDIPKLFSKFVHSDTMTTRNYGGTGLGLAICKRFVNLMEGHIWL
ESEGLGKGSTCIFIVKLGIPDPIHEMEHQYVFPIPSNSTRKDFPGLK
VLVTDDNGVNRMVTRSLLARLGCDVTVVDSGHECLQAMSQAGQNFKV
LFLDVCMPGMDGYEVAIHIQEMFPNRHERPLLVALTGSADKATKEKC
IKIGMDGVLLKPVSLEKMRSVLVDLLEHGSVCDSIQRL

350 MSFRKRALFKVIVLGDSGVGKTSLVTQYVHKRFSSQYKATIGADFMS
KELQVDDRLVTLQIWDTAGQERFQSLGVAFYRGADCCVLVYDVNVLK
SFDNLENWHKEFLNQASPTEPDTFPFMLLGNKIDVDGGNSRWSELKA
MTWCKSKGIPYFETSAKDDYRIDAAFLSIARSALKNQPEQEIYFLGL
PEALPESEPPSRSFCGC

351 MWRRMSSFPDELLEHVLAFLSSHRDRNAVSLVCKSWFRIEAGSRQRV
FIGNCYAVSPAILIRRFPRIKSVALKGKPHFADFNMVPPGWGADIHP
WLAAMAEAYPWLEELRLKRMVITDESLQLLARSFPNFKVLVLTSCDG
FSTDGLAAIAAHCRHITELDLQESDIDDRGGNWLSCFPDSCTSLVSL
NFACLTKEVNFEALERLVARCTSLRSLKLNIVLPLELLHRLLVRAPH
LEDLGTGAFLHEPRTEQYSKLKVALQNCKRLQSLSGFWEVAPGYLPL
VESLCSNLTSLNLSYATIQSAELTNLLGHCHKLQRLWVLDYIEDKGL
EWASTCKDLQELRVFPLDPYGQGAVTEEGLVTISRGCPKLTSVLYFC
CQMTNAALITVARNSPLLTCFRLCIFDPTSPDHLTKQPLDEGFGTVV
QSCKSLRRLSMSGLLTDKVFQVIGTYGKCLEMLSVAFAGDSDFGMQC
VLSGCINLRKLEVRDSPFGDLLALLAGSEKYESMRSLWMSSCSVTVHG
CKELAAKMRNLNVEVIHDRDQFEDISTMTQPVDGLYVYRSVAGHRKD
TPHFIYTM

352 MAQQSLIYSFVARGNIVLAEHTSFSGNFSIIAVQCLQKLPSNSNKFT
YTCDNHTFNYLVDDGFVFLWADEAAGRQVPFIFLERVKEDFKRRYGG
RAETSMAHSLDKDYGPILRDHMQYCMDHPEELSKFFKIKAQVSEVKG
IMMDNIEKVLDRGEKIELLVDKTEGLQFQADNFQRQGRQLRRKMWLQ
NLKFKLIVLGIVLVIMLIIWLSICKGFSCH

353 MSIISIPEVEVEMGSASPNARTLRATWQASTVFYDTPATLDKAERLI
AEGAAYGSQLLVFPEAFIGGYPRGSNFGAVIGNRTFKGREEFRKYHA
SAIDVPGPEVERISAAAAKYKVHVIMGVIERAGFTLYCTVLFFDSQG
RFLGKHRKLMPTSLERVIWGFGDGSTLPVYDTSIGRVGALICWENRM
PLLRTALYGKGVELYCAPTADARESWQASMLHIALEGGCFVLSANQF
CRRKDYPPPPDVFGGSEENMSPESWCAGGSVIISPTGTVLAGPNFE
GEALITADLDFGEIVRAKFDFDVVGHYARPEVLKLTVNDYPLNPVTF
SSGIAASEKKDSENV

354 MEDDPGEDYLFKVVLIGDSAVGKSNLLSRYARNEFHMNSKATIGVEF
QTQSMEFDGKEIKAQIWDTAGQERFRAVTSAYYRGAVGALWYDISRR
HTFESVGRWLDELKMHSDMNVVTMLVGNKCDLESLREVPVEESKALA
EAEKLFFIETSALNATNVNDAFQIVIKEVYNNMSRKALNSGSYKSKL
LSNGSTSVNLVQNGDAATKTGLKKYGCC

355 MAVPVIDIKKLLDGEEREMTMDQIHKACQEWGFFQLVNHGIPYSLLD
RVKVLFKEHYKNSMDAQFQDSSAWQMLESSNSQGMNLSATKIDADWET
GFFLPLSSHKTETVTPPLPANFRETMEEFAEEVKGLAERLLEIMCEN
LGLEKVYLKEALAGGNGDNNSPFFGIKMSHYPPCPRPDLIDGLRNHT
DAGGLILLLQDDEIDGLQVLMDGIVVFDVQPIQHAIVIDIGDQLEVM
TNGKYKSMWHRVLAKEDATRMSVAAFYNPSSDAEVYPASQLMSAEQN
GSNNVNAESGYDYPKFVSADYMTVYAAQKFLPKEPRFEAMRSVGHAV
N

356 MATKVDPPNGVAAEGKHYYSMWRNTFEIDTKYIPIKPIGKGAYGIVC
SAKNTETNEKVAIKKIGNVFENRIDAMRTLREIKLLRQLAHDNIITL
KDIMTPVGRSNFRDVYLVYDLMDTDLHQIIKSSQALTDDHYQYFIYQ

LLRGLKYLHSANVLHRDLKPSNLLLTANCDLKICDFGLARTNCETGQ
FMTEYVVTRWYRAPELLLSCDEYGPSIDVWSVGCILAELLGRQPIFP
GKDYINQLKLIINVIGSPAEDDLYFVQSQKACSYIKSLPHVPSASLQ
RLYPQANPTAIDLLDKMLVFDPYKRITVTEALEHPYFSALHDPRLEP
SATAPFELDMPDEELRVQELREMVWKEMLYYHPEAANIL

357 MGIELEMDRPQEEGWVRGAILGAGAYGTVSLGVSRSNGQLFAIKSAA
GFSVALENEYQILRCLDCPYIVRCLGHNYSFENGAEVHNLFLEYMPG
GSLVDLLGRFGGTLNETVIRAYTRGILRGLDYLHSQGIVHCDIKGKN
ILVDSNGVKLADFGSAKRVDDEEKCEEAMQLRGTPQWMAPEWNQVEQ
GPASDIWSLACTVLEMATGRPPWSHVSSPLAAMYRIGCTEELPGLPG
CLSPQIRDFLEKCFRRDPKKRWSSAELLNHPFLKKDCSVIEAEEEAIR
GPGSPTSHLDFRNHIWDSYDSQTTLIPSLSLPSPTRERNAEVNRSVE
QCPRRSPRDRLMALAAACKFEKVANRPNWITSLHGPWTVVKSSRSKS
PTSDKPLLKSDISNGSSIQELPFTEERCSTSFKAVNWKGLQPRGELD
QCSQAMLSSAQSQHQPSSSTSSKTPHHNLFSLAETSNLTGEAWESDG
NSSQRIVGGD

358 MSGRRNPLLNIPIPARQQTQLYRLPLPPQSTSVSRDVSDLADLERIQ
ILGHGSEGNVYKVRHRRTSELYALKVIHGNHDETVRQQIIRQMEILK
KTESPYWKCHGIFERGEEIHFVLEYMDGGSLEQRRSDTMSERFLAEV
ARQVLEGLKYLHRHKIVHRDIKPSNLLINRRQEVKIADFGVSRILSQ
TLDPCNTYVGTCAYMSPERFDPETYGGRYDGYAGDIWSLGLSLLECY
TGHFPPFLAAGQKADWPALMCAICYGDPPAPPPTASAHFRSFITCCLH
KDARNRWTAAQLLGHPFVLSNPPQTPSIPMQRLSI

359 MATRVNPPNGVFVEGKHYYSMWRNIFELDAKYIPIKPIGKGAYGIVC
SARNAETNEKIAIKKIINAFENQTDARRTLREIKLLRLFAHDNIIAL
KDIMTPVTRTNFNDVYLVYDLMDTDLHQIIKSSKVQLTDDHCQYFIYQ
LLRGLKYLHSANVLHRDLKPSNLLLNANCDLKICDFGLARTNCEKGQ
FMTEYVVTRWYRAPELLLSCEEYGTSIDIWSVGCIFAELLGRKPIFP
GKDYINQLKLIVNVLGSPDEDDLEFIESQKARSYIKSLPVTSHASVQ
RLYPRANPSAISLLDKMLAFDPRKRITVTEALEHPYFSALHDPSLER
SATAPFDLDMPEEELKEEELKEMFWNEMLHYHPEAANTS

360 MRQEHSENPEEEERVSFDLNSMCKFSSQSDTEPIETSFPDEVLEHV
LVFLTAHKDRNAVSLVCKSWYREAWTRHQVFIGNCYALSPGTMINR
FPKIKSVTLKGKPRFADFNLVPPNWGAHLHPWVLAMAPAYPWLEKLL
LKRMTVTDEDLALLADSPPNFKDLVLLYCDGFSTKGLGIIASKCRQL
RRLDLNEDDIVDSGVDWLSCFPETTTTLECLSFECLEGPINIDALER
LVARCLSLKELRLNRTISIVQLHRLMLRAPQLTHLGTGCFSYDFIPE
QATVLQVAFNNCKSLQCLSGFREWPEYLPTIYSVCNNLLELNLSYAV
MGSRELEQIVCNCPKLQRLWVLDSVEDAGLRAAAATCKDLRDLRVFP
MDAREDGNGCVSDEGLVAISEGCPNLQSILYFCQRMTNAAVVTMSKN
CQNLTSFRLCIMGRHKPDHITHKPMDEGFGAIVMNCKKLTRLAVSGL
LTNKAFEYIGTYGESLETLSVAFAGENDLGMKYVLDGCRRLRKLEIR
DSPFGDTALLSGLHHYEQMRFLWMSDCKVSIQGCMELARKMPWLNVE
IIRENSYDDRLVEKLYVYRSVAGPRKDMPPIVITL

361 MGSSSHRENGAVKAVSCSKEDKLEQSRVNLMRSIVEAKDSSAKATDD
ATLRRFLRARDLNVGKASELFLKYLKWKRAFVPLGYIPESEVSNELR
KNKIFIQGLDKDRRPIGVILAARHNAFDRDLEEFKRLVVYGFDKICA
CMPRGQEKFVMLADLEGWGYKNVDIRAYLMVLEIMQDCYPERLGKLF
MIHVPYLFWAAWKTVYPPIDKVTKKKIVFVEDKHLKETLLNDIDESQ
LPEIFGGKLPLVPTQDCVIPN

362 MENVGGEEYLFKIWIGDSAVGKSNLLSRYARNEFNANSKATIGVEFQ
TQVMDIDGKEVKAQIWDTAGQERFRAVTSAYYRGAVGALIVYDISRR
LTFDNVARWLEELKMHADGNWKMLVGNKSDLAHIREVPVEDGKKLAE
SEGLFFIETSALDNTNVLPAFQIWKEIYTNVSKKMLNSDSYKSQLSL
NRVNITDAYGDGDGVDPPKTKNSCC

363 MGHAASWIPPQETKQEDEDSQEGVDYTLNIPDECLAHVFHYLKPGDR
KPCSLVCKRWHHAEGQSRRRLSLDARAEIVPAIPSLFWRFNYVSRLA
LRGNRRTIGINDDGLLLIGIHCKNLKNLKLRSCREITDIGMSRFAQL
CGSLRKFSCGSCTFGTPGINAITTHCKSLEELTVKRLSAGEVPSEP
VGPGAGNLKRICLKELYYGQFFVPLIAGSKKLQTLKLSKCSGDWDTL
LDIITQDVTSLVEVLLERLHVSDTGLLAVSKLASLEILHLAKTPECS
NTGLAAIANGCRKLRKLHVDGWRTNRIGDEGLIEIARKCHYLKELVL
IGVNPTITSLSMLASNCHVLERLALCGSATIGDAELSCIAAKCYSLK
KLCIKGCPVSDQGMESLISGCPMLVKVKVKRCRGVTSEGADLLRANK
GSLDVSLDTITSPSLNGLSTQASSSVPRASAISSAGKSTLKARLTL
IAGGSFLACAFLKLSNGS

TABLE 3-continued

Cell Signaling Protein Sequences

SEQ ID NO | Sequence

364 | MAGLDNGWNGIVSVKFTKLFIDGKFVDAISGKTFETLDPRTGDLITR
VAEGDKEDVDLAVKTAREAFPDKGPWPRMSGYERGRLLNRYADLVEQY
IDELAALETLDNGQPLTLVRVIVTGCIQILRYYAGAADKIHGETLKM
GGQYQAYTLHEPIGWGQIIPWNFPLFMFFMKISPALACGCTIVIKPA
EQTPLTALYCAHLAKEAGLPPGVLNVITGFGETAGAAISNHMDIDKV
AFTGSTDIGRVIMVAAAHSNLKPVTLELGGKSPLIIMDDADIEEAVN
LAHKAIFFGSGQVCCAGSRIYVQEGIHDKFVKRVVERAKKQWGDPFN
PEVDHGPQIDKTQFEKILEYIEHGKREGAKLLTGGSRVGEKGFYIEP
TIFSHVQEDMKIGKEEIFGPWSIFKFRTIEEAIELGNKTIYGLAAGI
VSKNIDTVNRLSRSIRAGVIWVNCYHWFPDAPFGGYKMSGIGREQGL
DVLKNYLAVKCVITPLHDSPWL

365 | MRKKDLKKLKLAVPAPETPMSDFLTASGTFQDGDLLLNRQGLRLISQ
EDDESPSPIEPLDNQFTLADLETVSVIGKGSGGWQLVRHKWTGQFFA
LKAIQMSIQESVRKQIVQELKINQASQCPNVWCYHAFYNNGVISIVL
EYMDCGSLADVIKRVKTFTEPYLAVICKQVLKGLIYLHRDRHIIHRD
IKPSNLLVNHKGEVKITDFGVSATLANSMGQRDTFVGTYNYMSPERI
SGSTYGFSSDIWSLGLVVLECATGRFTYLPPGQEEGWLNFYELLETI
VEQPAPCCASPDEFSPEFCSFISACVQKDPKDRMSATDLLNHAFIRKY
EDQNVDLAALLSSLSSPV

366 | MALMMEFGDDAGIGEEWEDNESQRMEIDTGKGIETHFNDIPEVIMSN
IFSAIKDTRSRNRMALVCRKWHEMERATRVYLCIRGNISNNLYRLPM
CFQSVTKLDLSLCSPWGYPPLDFTTPHGNFIGHRLKDAFPRVNNIVI
YVRSARNIEKLSSLWPCLEHVKLVRWHRRAMDPESAVGLGMELKLLM
QNCTALKSLDLSQFYCWTEDIPLALQAEPHVSANLSSLNLLKLSAEG
FRAQELAAISGACRNLEELLAVCVFDPRYMDCVGDEALWLARNCSRV
RILHLVDATAFEALRGDPEDIFSSENAKITRQGLESMFWNLPLLEDL
VLDISHNVADSGPALEFLSSHCKNIKSLKLGQFQGICKGPEPDGVAL
CTNLEALFIKNCSDLTDTGLAAIAAGCSRLGKLELQGCRQITEAGLK
FCTSRLSKTLVEVRVSCCKYLDTAATLRALEPICESVRKLHIDCIWD
KSILDQEIASPSRRLNPVGSSAISTREIASYGMGKNHLVSAGDCNVN
RWDQNPESAWGPSLQLAPPQFCPDLNCANFDFGSSPSDVPMTNWGLD
LNLTASSCSGPLESSEERGCLPIENFFEEHEKPNSLGSDRYVPSDGV
MFRGMDVNGKAPQMERLCHSNTGTVSDSSSTEFVDFLGINDKHQEWQ
KLGADINYGMEVMVNSSQIWGVTGEASKRTSSANLEGEQSWTEIPNQ
YSYSDSSSHIRSITWKNLQFLSLWIPVGELLSPLAAMGLKVCPLLEE
ISIQVEGDCRLCPKPRERACGLSSLGKLVPSLSELLNCGEVIGFALS
APAGKMDLSLWERWYLNGLRELHLSELNYWPPQDKDMNRRGLSLPAA
GLLSECAALRKLFVHGTCHEHFMMMFIRIPDLRDIQLREDYYPAHED
DTSTEMRTDSCRRFEEALASRGFTD

367 | MQQDQRRKAPTEVEFFTEYGEASRYKIQEVIGKGSYGWCSAIDTHTG
EKVAIKKINDIFEHISDATRILREIKLLRLLRHPDIVEIKHIMLPPS
RREFKDIYVVFELMESDLHQVIKANDDLTPEHYQFFLYQLLRALKYI
HTANVYHRDLKPKNVLANADCKLKICDFGLARVAFNDMPTTIFWTDY
VATRWYRAPELCGSFFSKYTPAIDIWSIGCIFAEILTGKPLFPGKNW
HQLDLITDLFGTPPIEAISRVNEKARRYLSSMRKKQPVPLSQKFST
ADPLAKLLERLLSFDPKDRPTAEEALADPYFKGLAKVEREPSAQQI
SKMEFEFERRRVTKEDVRELIFREILEYHPQMLKEYLNGSDRSNFMY
PSAVDQFKQFSHLEEHYGKGAPWPLERQHASLPRSSWHSNTMPPLP
EKTISGPSRDRTSESRDESSSRYIRETEKLQHDRSAGNALKAPLQPPQ
KILQGGAAKPGKWGPLPYENGSTKEVYDPRRLIRNAVLTTSQYAAPI
YSYPRRTSNTKIEPNEKEDAESTLMPPKAQYVGIGAARKVAAVQSAS
SRLY

368 | MGPCNGRFSALILISMTPPPSRVGVLISLFIMSLLLCISAPCMHSPA
AALIGLSRSEKYNTDGQDPCRLSFLDTAAAAIDFGRIYHHNPAAILR
PVSAEEIARFLRAIYASRALATGYRQEYLTVAAKGAGHLSIMPAGDP
DGLVIEMSSLRGVRIHVADRAGGYSYADVAAGELWVDLLAEAMKLGL
APRSWTDYLYLSVGGTLSNAGISGQTFRHGPQISNVLQLDIITGTGE
LVTCSPAENADLFYASMGGLGQFGIITRARIILEPAPQKVKWVRALY
SDFEQFTRDQELLVSMDDGASVDYLEGFWVNNEAMRSWSISFRTD
PLDDSVFNDAGTEILFCIEIAKYFTQSDDETADVDKVTGRIISRLSF
IPGLIYSVEVPYADFLNRVRVEELNLRSRGLWDVPHPWLNMFVPRRQ
IQRFTTSSLLRIMSPDTVKGPILVYPVKRSKWNTNMSAVIPEDKDEIF
YAVGVLRSADPLCLAGSSCLNDLLSQNQQIIDVSTNANEIGNDKTEP
GMGAKQYLAHHSQQWQWKNHFGSKWGIFLQRKARYDPLNILAPGQRI
LNRNHRE

369 | MDQDQSICRFAAQKGKGEIQSSSFPDEVLEHVLVFLSSQKDRNSVSL
VCKAWHRVEAWTRQQVFIGNCYAVSPQIMIKRFPKIKSVSLKGKPRF
ADFNLVPPNWGAHLTPWVSAMATAYPLLERLYLKRMTITDYDLTLLA
NSFLYFKELVMVCCDGFSTGGLASIASKCRQLTTLDLNEDEIHDNGE
DWLACFPETLTLSRSLCFDCLEGPVNFDALERLVARCPSLKKKLRLNR
NVSIVQLQRLIIKAPQLTHLGTGSFFYEFQLEQVADLLAAFSNCKQL
QCLSGFREWPEYLPAVYPVCSNLTSLNFSYAVIGSRELEGIVCHCRK
LQLLWVLDSVGDKGLEAAATTCKDLRDLRVFPVDAREDGEGCVSERG
LVAISEGCPNLESILYFCQRMTNKAVVTMSHNCSKLASFRLCIMGRH
QPDHLTGEPMDEGFGAIVRNCKSLTRLAVSGLLTDKAFQYFGAYGER
LETLSVAFAGESDLSMKYVLDGCKNLRKLEIRDSPFGDVALLSGLHH
YENMRFLWMSDCRLTLQGCTELAKKMPGLNVEIIRENECNDSLVEKL
YAYRTVAGPRKDMPSFVTIL

370 | MASTPVSSSASQPNLLRHYTPTVTDCSSSGSSIPWDLSAQKTSWQAL
VKACEDYGFFKVVNHGISQVLIDAMEAEAEKLFALPLSEKERAGPAD
PYGYGNRSIGRNGDVGWIEYLLFRSDFQYVQQRYKAISPDNYINFCN
TASKYISATKKLACDILELLAEGLGLPENIFSSFLTAEGSDSAFRLN
HYPPCPDPSNIIGFGEHTDPQILTVLHSNDVGGLQVLSRDGKWVTVS
PDPSSFSINIGDCMQVLTNGRFKSVRHRAVTNTLRSRISMMFFGAPA
LDATIVTPSQLVDEDRPAQYMPFLWSQYKKSIYCLKLGQTRGLLQKF
QASMVGVGVA

371 | MGSSGRHENEAEKVVSCYEGDTIEQNRVDLMRSIIEVKYPSAKVTDD
ATLRRFLRARDLNVEKASQLFLKYLKWRQALVPLGYIPESEVSNELR
KKKVYIQGFDKQRRPIEVILTARHYASDRDLEEFKRLIWGFDKLCAS
MPTGLETFWIADFEGWGYSNMDTRAYLAALEILQDCYPERLAKAFMI
HVPYLFQTAWKMISPFIDKVTKKKIIFVEDKHLRSTLLNDIDESQLP
EIYGGALPLVPAQDFVIPNWS

372 | MAIPVIEMGSLIGNDKERFMAEMGKACEEVGFFQLKGHGIPVELMER
VKKVCSEHYNHVREPKFKTESVPVKLLNKSLMEAELSSSEPKKVENV
DWEDCIVLQYAQEDYPWPSDPSEFKETMMEFGKEITKLAESLLELLS
EILGLEKGYLKRTLSGGDGPDDKAFFGTKISHYPPCPRPDLVEGLRA
HTDAGGLILLFQDDEVGGLQVLDNTGRWIDAPPMKDTLVIDIGDQLE
AISNGRYRSAWHRVLATDSGNRMSVASFYNPSLDAVISPAPELLSQP
KKGSELSLYPKFMFGDYMNVYAQQKFLPKEPRFQAVAALQY

373 | MMEALPDQWWEVLDRIKETRDRNTAALLCKRFYQIEKNQREYLRVGC
GLSPAIEALSALCMRFPNLVRVEIGYSGWMSKLGKQLDNEGLKILSQ
HCPNLTTLSFCTFITDGGLGYEVLSCSTGLKALRLNFTPGITGCGIL
SVWGCKKLSTLHLTRCLNVSSVEWLEYLGRLESLEDLAINNCRAIGE
GDLAKLGYGWRNLKRLQFEVDANYRYMKVYGRLAVERWQKQWVACEA
LEDLSLVNCLISPGRGLACVLRKCQALQNLHLDMCVGVRDDDLISLA
QQCPKLKTLSLRVPSDFSVPILMSNPLRLTDESLKAIAQNCSELESV
SISFSDGDFPSSSSFSLAGIVSLIEACPIRVLVLDHVYSFNDSGMEA
LCAAHFLEILELIQCQEVTDEGLQLVKHFPCLSVMRLCRCLGLTDIG
LKPLVASHKLQKLKVEDCPQISEKGTQGAAKWSYKQDLSWIY

374 | MDPMERAAKVLGSSPGHKNMMGCSSSGVKVEPEIDGLLANAGYTVKA
SDLAHVAQRLEQLESIMGTVQDPGISHLASEAVHYNPSDLAGWIESM
FGELNPGADMPVPFGDRGSLIDSSQVHKPIQDDPSLSAMDLALIHEY
GLQFNGSQASNPQGFSPDSDPSVRCNIFSGPPLRSGDSTTHTNFQAR
SFSAQSSDEGSSLSTTRLGTAQQSIDNGAQESGIRWHLLMGCAEAIQ
RNNLKVASNLVREIRMTVNSAPCGAMGKVASHFVEALARRICGLNGA
ESNMSQADAQSEILYHHFYEVCPYLKFAHFTANQAILEAFEGHGSVH
VIDLNLMHGLQWPALIQALALRPGGPPLLRLTAIGRPQPDGRDVLQE
IGMKLAEFAESVNVEFDFRGVMADKLEDIKPWMFQVKPGEWAVNSVL
QLHRLLYIDAPTGSSPIDWLKSIGSLRPKIVTVVEHEANHNGPVFLD
RFVEALHYYSTMFDSLEACNVLPNSMEKFLAELYIQKEICNIVACEG
RYRIERHETLSHWRIRLGRAGFRPSHLGSNAFKQARMLLTLFSGEEY
TVEENNGSLTLGWHSRPLIAASAWQGS

375 | MASNSRYTQSQSTGSNNRRSSTNTNTTTNKATAMAQYNADARLLQVF
EQSGESGKSFDYTRSVKSTTESVPEQQITAYLSRIQRGGRIQPFGCV
LAVEETTFRIIAYSENAVEMLDLAPQSVPSMEQPQQDVLTIGTDVRT
LFTAASAHSLEKAAVAQEISLMNPIWVHCKNSRKPFYAIVHRIDVGM
VIDLEPLRTGDAFMSAAGAVQSQKLAVRAISRLQSLPCGDVGLLCDS
WENVRELIGYDRVMVYKFHEDEHGEWAEIRRSDLEPYLGLHYPATDI
PQASRFLFMQPNRVRMICDCMATPVKVIQSEELMQPLCLVGSTLRAPH
GCHAQYMANMGSIASLVMAVIINGNDEEGGSGRNSMKLWGLWCHINT
SPRAVPPFPLRYACEFLMQALGLQLNMELLGGLAQLTEKHILKTQTLLC
DMLLRDAPMGIVTQSPSIMDLVKCDGAALYYGGMCWMLGVTPTEAQI
KDIADWLLEHHGDSTGLSTDSLADAGYPGAASLGDAVCGMASARITS
KDFLFWFRSHTAKEMKWGGVKHHPDDKDDARRMHPRSSFKAFLEWKR

TABLE 3-continued

Cell Signaling Protein Sequences

| SEQ ID NO | Sequence |
|---|---|
| | RSLPWDNVEIDAIHSLQLILRGSFQDIDDSGTKTMVHSRLNDLRLQG IDELSSVASEMVRLIETTTAPILAVDYNGLVNGWNAKVAELTGLPVG EAMGMSLVQDLVFEESVERVEKMLHNALRGEEEKNVEMMLKTFGPQK EKEAVILWNACSSRDFTDNIVGVCFVGQDVTSQKVVMDKFIRIQGDY RSIVQSPNPLIPPIFASDEYACCSEWNAAMEKVTGWTHDEVIGKMLV GEIFGGCCRLKGQDAVTKFTIVLHSAIDGQEIEKPPFAFFDKQGKYV EALLTANKRTDADGRITGSFCFLQIASSELQQALEVQRQQEKKCFAR LKELAYIRQEIKNPLYGMMFTRKLLEETDLSDDQKQFVETSAVCERQ MQKVMDDMDLESLEDGYMELDTAEFILGTVIDAWSQGMIVLREKGLQ LIREIPGEVKTMRLYGDQVRLQQILADFLLNVLRFTPSPEGWVAIK FPTLKQLGGGLHWHLEFRITHPGPGLPAELVQDLFDRSQWATQEGVG LSMCRKLLKLMNGDVQYIRESGICYFLVNVEFPMAQREDAASIK |
| 376 | MATVGNKNVQAKLVLLGDMGAGKSSLVLRFVKGQFFAYQESTIGAAF FSQTLAVNETSVKLEIWDTAGQERYHSLAPMYYRGAAAAIIVYDITN LDSFVRAKKWVQELQRQGNPNMVIALAGNKSDMIENSKVSPEEAKVY AQENGLFFMETSAKTAQNVNELFYEIARRLPKAEPVQHPAGMVLADR SAERARSNSCCS |
| 377 | MADSSVRSESVYMSKLAEQAERYDEMVEYMGKVVKAADVEELAVEER NLLSVSYKNAIGSRRASWRIVSSIEQKEESRGNEDRLPLIRQYRLKV EAELSGICDSILGLLDGYLIPSASCGEAKVFYLKMKGDYNRYLAEFK TGDERKEAADGTLEAYKNAQGIALVELASTHPIRLGLALNFSVFYYE IMNNMPEKACALAKQAFDEAIAELDTLGEESYKDSTLIMQLLRDNLTL WTSDMQEQLDDS |
| 378 | MDNGMMVWIVLAGWAMAVWYLLVQHQQPKQSHNVPWETLPPGAVGWP FLGEIISFYFRTPDFVKQRRGRYGNLFRTFLIGYPMVISTDPEVNKF ILNNDGRLFVPAYPSHWSQIIGECNIFAARGDFHKRMRGAFLHFISI SWKNRLLSEIQNIITFSLAGWEGRNVNVLHEAEEMIFSVMANHMLSL SAGTALESMKRDFLVMMKGLRSLPLRVPGTTFYKSLQKQVLFNQIK SIIEERKLNMSAYDSYDDLLSSILRSASEKEFTTTQIVDLIVQSVIG SLETTPKIMASWRHLSENPHIIIYLKEEHETIIQAKENNQSLSWDDY KSMVFTKSVIKETLRFGMQPLNNIMFKKTLQDVKIEGYTIPKGWTCI IYDLVSDMDTKYCKDPLSFNPQRWQSKEMNEVPPLAFGGGPRLCPGY ELAMLTMSFFLHHLVTKFRWEYLPSKSELRWFDSPLNSVFDCRIHVE NR |
| 379 | MAILYALVGRGTWLAEFSAVGGNAGTVARRIMEKLPLQDRGEGESRL CYSQDRHIFHILRGSDGLTFLCMANDTFGRQIPFAYLEDIQMRFMKT YGRVAQNALAYAMNDEFSRVLHQQMEYFSSNPNADTLTRVRGEMNEV RTVMVENIEKILERGDRIELLVDKTSTIQDSSFHFKKQSRRLRQALW MKNAKLLASLTCLIWLLYIIIALCCGGITLPSCRS |
| 380 | MGEFKKWKRCNSLPSPINSLDDGCLMRIFSFLSPLPDRYSAARVCSR WRHLASDPRMWLRVEKSCNALAESGIFSTIEDAWAARPGDTILIATG WHMACNIQIVKPICLVGGGSSPDEWLVCPRGFDSALEFLSTGKVANL TIKAELGSCLLHRNGRLTVEGCVLQCEEHPLEHLCCPIVSTADALAP PSTLSSVMKGGSSMSVIHTRIKGGAKAVLTNGSLTLQQVRVIYSPTA LFFWFNVSQKSLTDIDLPPFICKA |
| 381 | MGSTNNQSERAFSIKLWPPSESTRLMLVERMTDNLSSVSFFSRKYGL LSKEEAAENAKRIEETAFLAANDHEAKETNSDDSSWQFYAREASRLM LEALKRGPTSQKQESEKELTAETVVKEVKETIFDISRGDRGFVDGTL AEEELLRPLTEEGNSYTKICFSNRSFGLDAARVAERALMEVQRNLTDV DLSDFIAGRPEVEALEVMTIFASVLQGCELRSLNLSDNALGEGKVRA FGPLLKSQKTLEELYFMNNGISVEAARAICELLPSVERLRVLHFHNN MTGDDGAEPLSELVRNCTALEDFRCSSTRVGAVGGIALVGALGAGNR LKKKLDLRDNMFGKKCGVALSRALSPHLGLTEAYLSYLGFQDKGTIAL ANSLKEGAPSLKVLELAGNEITVKAATALAECLGLKMTKLVLSEN ELKDEGSVLICRALEEGHEHLKELDLSSNSISGVGAKVAAELWNKPD FDLLNIDGNCISEEGIDAVKDVLRRGDKGVTVLGSLEDNDAEGEGND YEDGDEDDDENESSDSDGDLVAKVEDLKMQ |
| 382 | MSPAESSREESWMAKLAEQAERYEEMVEYMEKVAKTVDEELWEERN LLSVAYKNVIGARRASWRIISSIEQKEESRGNEEHVTMIREYRGKVE SELSNICDGILRLLDTHLIPSSTSGESKVFYLKMKGDYHRYLAEFKT GAERKEAAESTLLAYKAAQDIATAELAPTHPIRLGLALNFSVFYYEI LNSPDRACTLAKQAFDEAIAELDTLGEESYKDSTLIMQLLRDNLTLW TSDMQEETGGDEIKEAPKKEEGDGH |
| 383 | MARKVDDEYDFLFKVVLIGDSGVGKSNLLSRFTRNEFCLESKSTIGV EFATRTIQVDGKTIKAQIWDTAGQERYRAITSAYYRGAVGALLVYDI |

TABLE 3-continued

Cell Signaling Protein Sequences

| SEQ ID NO | Sequence |
|---|---|
| | TKNATFDNVKRWLRELRDHADSNIVIMLVGNKCDLNHLRAVPIDEAQ DFAEKEGLSFMETSALESTNVEKAFQSILAEIYQIVKRKSLAEEEAS SGPSQGTPINVTDAEAVAKKRSCCL |
| 384 | MNAGPLIAALRDCPLLAFPSWTMGIILAYFCYMALAQFILPGKQIPG WLADKTRIYYRCNGFITLFLLVTLLGISMAAGILSLAWADKGGELLS TTLILSALISLFLWAGHLSQSKMTSLKPHITGNFIHDWWFGIQLNPQ FLGIDLKFPLLIRSGMIGWAVINLSVAAKAFQLKDSLNLSMILYQIFC LLYVMDYFWYEEYMTSTWDIIAENLGFMLVFGDLVWIPFTFSIQGWW LLTHKPDLTTKAAAILDVLIFIIGYDSLRGSNKQKHIPKKDPTACIW GEPPKVIGGKLLASGYWGISRHCNYLGDLLLAFSFSLPCGASSFVPY FYPMYLLFLLLWRERRDEAKCREKYKEDWVTYCKLVPWRIIPYLY |
| 385 | MQRPSKTSVGYAIPDEVLKCVMGYLEEPCDRSAVSLVCKRWNRVDAL TRKHHVTIAFCYTISPSDLGARFPELESLKLKGKPRASMFNLIPQDW GGYAEPWINEISQTLLCLKALHLRRMIWDEDLRALARARGHILQVLK LEKCSGFSTLGLLEVARSCRSLRVLFLEESTIEDEGGEWLHELALHN SSLEVLNFYMTGLENVNVNDLEMIATNCRSLTSFKISECDILDLRNV FKKATALEEFGGGSFSSSEEQAVEPNIYEMVKFPTNLMSLSGLNYMS ETELPWFFPRASSLKKLDLQYTLLSTENYCQLLQSCINIEILEVTNAI GDRGLEVAAENCKKLRRLRVERGEDEAGLEGQQNFVSHKGLSVIAQG CPNLEYIAVWSDMTNSALESVGKFCKNLRDFRLVLLDKKEQVTDLPL DNGVMALLLGCQKLKRFGFYLRPGGLTDIGLGYIGKFSSNVRWMLLG YVGETDFGLLEFSKGCPNLEKLELRGCCFSEYALSVAALSLRSLKYI WVQGYNATPSGFDLLAMERPFWNIEFTPASQVTVDGFNLEEEITEKP AQILAYYSLAGRRTDHPDSVIPLSLSSWNRQLQHVYEYSLFHAYEY |
| 386 | MAKLYLFVAALLLLSASSAASQSLNTSSDAIPGKDFSTGKQSVEYLR LFAEDISWSNNLVLGLLVPRSIWSPLPRVLQTWLRNYIATVVYFVSG SLWSFYIYYWKRNVYIPADSTPSKEPIFLQIMVTMKAMPLYCALPTL SEYMIENGWTRCYAAINEVGWPSYILLTITLYLLLVEFGIYWMRELH DIKVLYKYLHATHHIYNKQNTLSPFAGLAFNPLDGILQAIPHVIALF IIPTHFLTHELLLFCEGIWTTNIHDCIHGKVWPIMGAGYHTIHHTTY RHNYGHYTIWMDWMFGTLRDPTAEAKSVKNM |
| 387 | MAYKTEEDYDYLFKVVLIGDSGVGKSNLLSRFTRNEFSLESKSTIGV EFAARSVNVDGKSIKAQIWDTAGQERYRAITSAYYRGAVGALLVYDI TRHVTFENVERWYKELKDHTDVNIWMLVGNKSDLLHLRAVSVEEGKS FAERESLYFMETSALDSTNVENSFTQVLTQIYRIVSKRSLDTAEEAL STLPGKGQSISVNGKDEFTTKKAGCC |
| 388 | MPETREDSWLAKLAEQAERYEEMVENMKRVASSDQELTVEERNLLSV AYKNVIGARRASWRIVSSIEQKEESKGNEAQVSMIKGYREKIESELA KICEDILDVLDKHLIPSAASGESKVFYHKMMGDYHRYLAEFATGDKR KDSADKSLEAYKAASEVAVTELPPTHPIRLGALNFSVFYYEILNSPD RACHLAKQAFDDAIAELDTLSEESYKDSTLIMQLLRDNLTLWTSDMQ DSADKPADSKDEPAETPAED |
| 389 | MANERESKTFLARLCEQAERYDEMVTYMKEVAKIGGELTVDERNLLS VAYKNWGTRRASWRIISSIEQKEESKGTDKHVGTIRDYRQKIETELE KVCQDVLDVLDESLIPKAETGESKVFYHKMKGDYHRYLAEFASGEKR KNAATAAHEAYKSATDVAQTELTPTHPIRLGALNFSVFYYEILNSP DRACHLAKQAFDDAIAELDSLSEESYRDSTLIMQLLRDNLTLWTSSD GAEPAETGEAPKTEEAKPAETAEAAPAEPESKPAKEEEPAAPAAA |
| 390 | MDALLKQFERLQRPIDLVQTLHETQVKQVPARYILPSEQRPSRPLQV QQSLPVIDLAGLEDTDQRIKIVSQIAQASQEWGFFQIINHDIPVSLL ETVKRVSQEFFDLPLEERRKQCPVRPGVHMLEGYGRFFDISDDTVLD WVDTLVHYISPEWAKAVEHWPKNPSTYRETYEKYGEEVMKVMEKLLG LLSQGLGLDPKYIQTLNKESLLQVRINYYPPCPQPDMVNGFKPHSDV DMLWLLDDGVDGLQVRKDEDWFTVPSIPGALIINIGDLLQIVSNGKY KSAEHRAVANTKQSRMSMVMFLRPQEDVLIDTAPELIDEAHPSLYKA VKAGEYETEYNSKDFRGKDAVHTLRIEQA |
| 391 | MMESLRKLVYYACVSRGPVIVAEYNDLGDAEQLAIAVECLGRAPPFH SRFTHTIKNRRYSFLMDSEFVYYAIVDEALPKVKVFSFLEQVRDEFK RLLRAKGLSNSKDEILQGCGLGDDFASTFRRLVAPLVGIPQTEKRRM EEEEASARRQEDETETEVCSPTASAPLYGKPQPDSKPKDKKSLCSI PPLILKTNKHEKKKVRDQVTQVREIIMESSGKALDNGQKLEVTVDGN TGGAAALSLQRTASMRTKGQQIAQRMWWRNVRWLLLDFWCTILFVWV LCICRGFKCVSD |

TABLE 3-continued
Cell Signaling Protein Sequences

SEQ
ID
NO Sequence

392 MSPSDSSREEYVYMAKLAEQAERYEEMVDFMEKVAKTVDVEELTVEE
RNLLSVAYKNVIGARRASWRIISSIEQKEESRGNTDHVSIIKDYRGK
IESELSKICEGILSLLESHLIPSASSAESKVFYLKMKGDYHRYLAEF
KTATERKEAAESTLLAYKSAQDIAGAELASTHPIRLGLALNFSVFYY
EILNSPDRACALAKQAFDEAIAELDTLGEESYKDSTLIMQLLRDNLT
LWTSDLTDEAGDDIKEASKLESGEGQQ

393 MTEGSNYDFLFKWLIGDSGVGKSNLLSRFTRNEFNLDSKSTIGVEFA
TRSVQVDSKTVKAQIWDTAGQERYRAITSAYYRGAVGALLVYDIAKH
PTYQNVHRWLKELRDHADSNIVIMLVGNKSDLKHLRAVPTDEAKAFA
TENNLSFIETSALDASNVEAAFQNILSDIYHIVAKKNLENSSDVIQP
LEGRGIDIAKSEDDGGAKQGGKCC

394 MQRPSKTSVGYAIPDEVLKCVMGYLEEPCDRSAVSLVCKRWNRVDAL
TRKHVTIAFCYTISPSDLGARFPELESLKLKGKPRASMFNLIPQDWG
GYAEPWINEISQTLLCLKALHLRRMIVTDEDLRALARARGHILQVLK
LEKCSGFSTLGLLEVARSCRSLRVLFLEESTIEDEGGEWLHELALHN
SSLEVLNFYMTGLENVNVNDLEMIATNCRSLTSFKISECDILDLRNV
FKKATALEEFGGGSFSSSEEQAVEPNIYEMVKFPTNLMSLSGLNYMS
ETELPWFPRASSLKKLDLQYTLLSTENYCQLLQSCINIEILEVTNAI
GDRGLEVAAENCKKLRRLRVERGEDEAGLEGQQNFVSHKGLSVIAQG
CPNLEYIAVYVSDMTNSALESVGKFCKNLRDFRLVLLDKKEQVTDLP
LDNGVMALLLGCQKLKRFGFYLRPGGLTDIGLGYIGKFSSNVRWMLL
GYVGETDFGLLEFSKGCPNLEKLELRGCCFSEYALSVAALSLRSLKY
IWVQGYNATPSGFDLLAMERPFWNIEFTPASQVTVDGFNLEEEITEK
PAQILAYYSLAGRRTDHPDSVIPLSLSSWNRQLQHVYEYSLFHAYEY

TABLE 4
Cell Signaling Oligonucleotide Sequences

SEQ
ID
NO Sequence

395 ATGGTCTTATGCGATGGTGCAGTTAGTAGACTGTTGGTCTGTATTT
ACTTATTTAACAGA

396 TTTACCTTAAGATGAAAGGTGATTACCACAGGTATCTGGCAGAGTT
TAAGACTGCGACTG

397 AATAATTCTATAGACTCACACTACCAATGGTTCACAAAGTGATTGT
GGTAGACATATGTC

398 ATTAATTATGCAGCTTCTAAGGGACAATCTGACATTATGGACTTCT
GACATCCCTGAGGA

399 TCTTAGTGGGCGCTGGATTGCATCATCAGACGGGTCAAATAATATA
TAATTAGAAGTGTA

400 ATAATGTGTAATTCCAAATTATGAGGTATATTTGCAATAAACAAAA
TGCAGGTCATTTTG

401 GAACATAGACGAACTAGCTGCTCTGGACACTATAGATGCCGGGAAG
CTATTTAGTGTCGG

402 GGTCGGGAAGACGTCTCTCATGAACCAGTACGTCAACCGCAAGTTC
AGTAACCAGTACAA

403 AATTGGAAAACGCTCTTGGGTTTGTGAACGTGCTTCTCACTGCTTT
AGTGTTGGTTTTCA

404 AATTCTGCATTGAGTGTAGCAGATCCCTTCTATTAGATTATTCATA
TGACTATGTGACTG

405 TTCAATATCTCAATTGAACACGATAAAAGGCCTCCATGTCTATGCA
GATTGTTGCCTACT

TABLE 4-continued
Cell Signaling Oligonucleotide Sequences

SEQ
ID
NO Sequence

406 GTGGTCTGCTACCAATCTTTCTATGATAATGGTACCGTTTCTATTA
TATTAGAGTATATG

407 TTGCACTGTCTTATTTTATCAATTTGTATCCTAATACGTGGCCAAT
GAACTTTACGGTTT

408 AAGAAATATATAACAATGTGAGCAGGAAGGTTCTAAATTCAGATGC
TTATAAAGCAGAGC

409 TTCAGTTGCACAGTAAACATGTCTGTATCCTGTGCAGTAGGACTCT
TGTAACTAGTCTGT

410 TTTTGAAGGTTAATAAAAGTATTACGCTAGAACAATTACAGAGGCT
GCTTGTCCGTGCTC

411 CTCAAGAACTGTAGCATATGTTATGACCATTGCAAAGGTTTTAACT
GCTGCGGTATCATG

412 AAATCGTGCGTTGTGAAATTGGTTGTGTATAATCTCTAGAATCCAA
AGGCTTACGGGTCA

413 GAACTGTCTTCGGGCGAGTTTAATCATGTATCTGATTTACGATCGG
TGTTGTGAACGTCG

414 TCCCAACCGTTGGGGATTTTTTGACGAGTCAGTACCAAATTTATA
GTTGCCTACTGACC

415 TATATTTTCTCTTACACAAAATGTCGTCAGATATAAATTGGTCTG
GGAATTGTCGATGC

416 TGCATTGGATTCTACCAATGTCGAGAGTGCATTCTTGACTGTCTTG
ACCGAGATATTCAA

417 TGTATCAGATTCTACGTGGACTGAAGTATATCCACTCTGCGAATGT
TATTCATAGAGACT

418 TCCATGTACTAGGTTTCCTATCTAACCTGTAAATAGCCTTATTGCT
ATGAGACTTCAGGC

419 TTGAATCTTAGTTATGCTCCTGGGATCCCTGGAAGTGAGCTAACTA
AGTTAATCCGTCAT

420 TATGTAGATCTTTGTGGCTGTAACATGTACTTCTTGCTTACCTGTT
CGATGCTATATAAT

421 GAGTGCCACAGGATTACCCTGTCAGGACTATATGGTCTTGTCGTTG
GTTGTGGGGATAAA

422 CAACTTGTCGAATCACTTCGCAACCGGATTCAAAATGAGGCTACTG
TTGCATACTACTTG

423 TGTTTTTAGGACACAATGTATTAGGTGCTTGATGCTAGCGCGGACA
CATTGTATTATTTT

424 CATCAGACGGTGAATCCAAAGTATTTTACTATAAGATGAAGGGAGA
CTACTACCGTTATC

425 AAAGATAACTGATTTACCCCTGGACAATGGTGTCAGGGCTATTTTA
AGGGGATGTGAAAA

426 AGATTCTAACATAGTTATTATGATGGCTGGGAACAAGTCTGATTTG
AACCACCTAAGAGC

427 TATTTGAACTCTGTCCCAATATGTACTTTGATTTATGGATTGTAAC
GATGTACTCAATTG

428 GTCATTGTGACTCATGTTAGTATTTGACATGATTCGTGTTAAATTA
TTTATGAAATATTG

429 AGAATTGGTCCGTGATAGTGCCACCGGAGGTTGAGATCTATGAGCT
TAAAACTAATGCTT

TABLE 4-continued

Cell Signaling Oligonucleotide Sequences

| SEQ ID NO | Sequence |
|---|---|
| 430 | GGAGTCTTCAACGGCGGTGATGTAAAATATCTATCCCAATGTATACCTCCTGTCCTGGAA |
| 431 | ATGAGGGAGTTAATTTATAGGGAAGCGCTTGCATTTAATCCCGAGTATCTACAGTAATGG |
| 432 | TTTTTAAGAAGTGATAATGCACGAAGATATGTAAGACAGCTTCCACAGTACCCAAGACAG |
| 433 | TGCAAGGGTATCGACAGTCTGCATGTCGTGAAGGTCCCCGAGTGTTCGAATTTAGGTCTT |
| 434 | GCCAGATGTCTAATGCGGCCTTACTTACCATAGCTCGGAACCGTCCTAACATGACTCGAT |
| 435 | ATGATAGTAACTGGCCAGAACCTGACCGTGTGGGACGGCAAGAACTTGAGATTGTAATGG |
| 436 | TTTCCAGACTATTCTCTCAGAGATATACAGGATAATTAGTAAGAAGCCTCTGTCCTCAGA |
| 437 | AATCCGGGAGGGTGTACCAGGACTATTGTGAGGCCATGAGCAGACTGTCTCTAGGAATAA |
| 438 | CCCTTGGGATGCGTATACGATGCGGCTCAAGGTGTATCAATTCGTGTTACAGATACCATT |
| 439 | TTTGTAATCCCCCTGAATAATGGAGTTACTATTGATCAGTGGATATTGCTTACTATGTTG |
| 440 | GATTTTTAACCCCACGGTTGTTTATGATCACTTGGGCGAAATATACTCCGCACTCATTGT |
| 441 | GACAAGTTAAGACTATTCTAGAACCATATTTAGCAGTGGTCTGTAAGCAGGTCTTACAAG |
| 442 | CAGCGTCGGCCACTCTCGATAAAACTCTGGCCGCCTAGTCAAAGTACTAGGATTATGCTT |
| 443 | TCATTCCTTATGCAGTTGTGGCAATAGATTTGCCATGTTAAGTAGTGAATAGAGAACCCT |
| 444 | TGATCCTGGCGATGCGTTCTTGGTGCCAACCCCTTACTATGCAGGATTTGATCGAGATTT |
| 445 | TTCTTGTTGGTTCCTGCATTGAGAGAGACCTAATTGCTTGATGTCCTGTAATTTGTAAAA |
| 446 | CTTTACATGGTCCTTCATTATACTATAGCCTATAGAAGAAATACATTTGCATGTATAGTT |
| 447 | TCTCTAGATCCTTAGATTAAGGTTTGATCTGTGTATATGCTGTGTCGTTGCCTGAGAATG |
| 448 | GGATGACGATTTGTTTCAAGATCGTTTTAGCATTGCATACAACCTTGACCGAGAGTTTGG |
| 449 | CTTGACTCGATATCTTTGTGCTGTTGTCTGTAGTATATATCAGTACCAGTTAGTTTTACT |
| 450 | TTGGATTTGCTAGGATCTAACTGCCTCACGTTGGAGAGACTGGCGTTTTGCGGTAGCGAT |
| 451 | CAAAGCAGATACAGCTGTTGCCAAAAGTCTGAATAAGGAGTTCGGGCCAATTATGAAGGA |
| 452 | CGACTCTAACATTGTTATAATGCTTGTGGGGAATAAGGCTGATTTGCGACATTTACGTGC |
| 453 | CTGCCTTAGCATTAACGGGAACCACATGGGTGTCCATGTGTGGATTATGAAAGAGTATGG |
| 454 | TTCTTTTGAATTCGCTATCCAGTGTTGGTCAAATTTTAGCCAATAATTTAAGTTGTTTCT |
| 455 | ATGGAGCTAGTCGTTTGACTAGTACCTGTATGTAGATCTAATGGAAGCTACAGAGTTCTG |
| 456 | TTCGATGCGAAGTCTAATGACTATCGTGTTGTCAGGATTATCCGATACCTAGGTATTCGC |
| 457 | AAGAATCTTGAAGTAGGTGAAGAGTAGGATATGTTCTTTCTAGTTTAAGGTAATTTGAAT |
| 458 | GATGCTTCGGGCAGTGAAATTGCTGTTCGAGAACTAATGAAGGAACCTTCTTGACTAGTT |
| 459 | GTTCACTTCATTACGTTTTATGCGCCACTCTGGGGAGCAATCCTTTATAACGGTTTTTCA |
| 460 | GTTTTGCTCCTGTACCGTGAGACTCTCGTTTGGTACGATTTAGATACCGGTGACGTTGAG |
| 461 | AAAGGCGACTCGTGTTCATAGAAACATCTGCTAAGACTGCCACTAATGTTAGCAAACTGT |
| 462 | GGTCTTGTGGTTATATATGCCAGTTGTCTCTTTTACAGTGAGTTTTGTGTAACTCCTAAA |
| 463 | GACAGAGATCGCTAAAACCATAGAATCCGAGCTACAGAAGTTTGAAAACGGAAGTGGGAT |
| 464 | GAATCTCATTCTGACCCTGGCTCGTGAATACTTTCATATGTACACAGTATTTCACCGGAC |
| 465 | GGAGTTGTGTAGTGTTACTCTCCCGAATCAGACATTAAACACTTACTTCTACATGAGGCC |
| 466 | TGTTACTAAGAATAGGGTCTTGTTTCATGGTCTACTAATGTAATGAATCTCGCTCTTTAT |
| 467 | ACTTTCAGTACAAATAACTCACTCGTTCAATAATTTCCGTGGGCTGTGTTAATTTTAAAG |
| 468 | AGAGCAGTGATGGTCAGGCATATAAAGTTTATGTTTACCGCACTGTTGCTGGACCAAGGA |
| 469 | GATTAATTAAATCGGATTCCCCGAAATGGGATGACGTGCTATAAGGACGTAGCCACTGCC |
| 470 | GAACAATCCGCCCATGTACAGGGAGACCTCTTTCACAGAGTATTTTGGGTATTACCTCTC |
| 471 | TCTCTGCTCATTACCGTTTCAGTGGCTGATAATGGATTCCCACGATGCAATTGCGATGAC |
| 472 | TAGAAAATGCCTTTGCAGAAGTGCTAACGCAGATCTACCGTACCACTAGTAAGAAGACAG |
| 473 | GTTTTGTACTATTGGCGTTTGGCAGAAGTTATTTGGCCAGTACGTAGCTGGCTAAACAAG |
| 474 | TTTCACGGGGCATCTCTACACTGATGTAAATAATGTACTTATTTATAGCTGACAGTCGAG |
| 475 | AATTATTAAAGTGGACATCGTTTGTTTTATGTGACACACCTGACACTAATATTCGTAATT |
| 476 | TCTCCTAGTGTTGGTGTACTGTTGTAATCAATGGAAAGGTATGTTAGGCGACGATATTAT |
| 477 | CTTGGAAATGCTTACTTGCGAGTATCCTTACATTGAATGCACCAATCCGGCTCAAATTTA |

TABLE 4-continued

Cell Signaling Oligonucleotide Sequences

SEQ ID NO Sequence

478 TTCCTCTGGTGCTTCTACATTTATTACCTCAAGCGCAATGTTTACG
TCCCGAAGGATGAG

479 TGGTAGCATCGGTAGACTACATCTATGCTGTAAACTATTCCTATCC
TATAATAGTTGCAT

480 CCAATCCAATGTTATTTCTTATTAGCGCTAAGACCTTACCTCTGGA
TCCCTTCGTTGAAA

481 TAGATTGATCGATTTGAAGGCTATCTACTTTCAAAAGGATACATGT
TGTGCTTATGATTA

482 AATCAAATGCATTCTTGAGTGATGTCCTACTTAATTTGTCTTTCAT
GACGCGGCTTTCT

483 GATGTCGTTTGGTATGATTTACATGCTAGGTACATCAATAGGGTAG
ATATAAGGGGCATG

484 AGTTTATTAATGTAGGATTTCCCTTTTATAGTTAAAAGAGTGATTA
GGTGGGGTTAGACC

485 ATATCACAGAGCGTCCATGGTCTGCCACTATCTCTATTTGACAATT
TGTAATATGTAATT

486 ATATACGTTTACACGAGAGAAATAAATTACAATCTGCGATTATATC
CCGATCCACTAGCT

487 GGTCCTTCAAAGTACGTGGGCTCAAATAAAGCGTTAATATGTATGG
TAACTGGTACTTCA

488 GGGGTGTTAATCAAACGTTTACTTGTGTAACCAGTGTAGAGATAGA
ATTGTACTCTAGTA

489 GAAGGGCTGACAGATACAGGTCTTGGTTATATTGGCGAGTACAGCA
CTAATGTAAGGTGG

490 GAAATACCAAGGGCACTAGAGTTCAAGTAGACGTTTATAATTTAAC
CGGCCATTCAACAT

491 TTCAGTGGGGCAGAGACTCTGATTGCGTACAGCAACTTTAGTGTAT
TATATCAAGGTCAT

492 AGAACGAGTTTATGCATGAGAAGCTATGATCCCATGGTTATTAGGG
TGTAGGTCATTATT

493 TGAATATTGTACCTGAGAGCATTCATTGACTTGTAATGAATGTACA
CTCTCTTGGTCTCT

494 TTGTACTAGACTATACTATGGGACGCCTAACCTGTCATTTAAAAAT
GTGAGACTGTTCGT

495 ATTGTGTATTCCTAATCTGAGCCAACTATTGGCCTCTACTTTATTA
TCATTGGACATTAA

496 TCAATACTTTCCAAGGGGTTCGCAAGGTCTTTTGCAATGTCTAGCC
AGATTATTCCATGT

497 AGAAGCCCTTCCGTGTCTTCGATATACGTGCCCGATCTTGTAGACA
ATCTTTAGTATATG

498 TCTTTTGGCATAGTGTTTCCTGATGCACGGTGCAGATATATGACTT
GGCATCTAGATCAG

499 GGAAAAACTTTGACCGATTTCTGGAATCACTTATAGTTGAATTCGA
GCAGGTTCTCATTT

500 ACAAAAGACCAGTAGGACATTATGGGGTCTTAACTTGGTGTGTATA
CCATGGCTATTAAA

501 TTGGCGAATCTACTGTTTTCTACTATAAAATGAAAGGAGACTACTA
CCGTTATCTGGCTG

TABLE 4-continued

Cell Signaling Oligonucleotide Sequences

SEQ ID NO Sequence

502 GTGAAATGTGATAATCTTATAGTGTATTAGGATTAGGATTAGATTA
CCAGGCTTTCCTGC

503 ATGGTAGTTTACCAGATTATATGGTTACTATCAACTGTTCGATTGT
TCTAGTGTGCAGTA

504 TCAGACGTTAGAACTCTGGTTAGCTGTGCATCCTATAGTAACGTCT
CTGTAATACGGTGT

505 AATTTGGAACTCAATTATCATGGCCATATCAAATGCGAAATGAAGG
GTGTCATTGTTTCT

506 TTTGTGCACCCTGTTACAACTCGCCAGTATAGGTCTAAATCTGCAT
TTACACAACCCACT

507 AGATTGGAGTTGTGTATTCTAAATCGAGGCCAGCTATTGGGCCTTA
TGCGATTATTATTA

508 GGTTCTGGTTATAAACTTATGTTCAATAAAGAATTAGAATTAGATT
AATCTATATAGGAA

509 TTCAGTCATCCTAAACTGCAGGTCTACTTCCGAGAGTTGTTGAAAC
CCGTTTAGATTCTA

510 ATTCGAACCTCGACTATTCAGTTTCCGATGCGGTCAGAGACAAGCT
GCGGCTTATGAGAG

511 GGTTTAAGTTAGGTTGGAACTTTGAAGTACATTAGTGTTCTGCACT
TTATATCCTAAGTT

512 TTATTACATTACCTGGGTAAGAAGTGGAGTTTAGCTGCTCAGAGGC
AGATAGTAACAAGC

513 AGCTATTATTTGTTTGAGGAGCAATGGACATGACACCTACATATTT
ATTTAAGGTAGGGA

514 GAATTTCCGTGGTTATGGCTCTGCTACATATGGGCAACCTGTTAGG
GCTATCCTACTAAA

515 AATAAGGTGGATTATTAAATCGCGTATTTTTAACTTATCTAATATC
TATTTACTGACTCG

516 GACATCTCCGCTCTTTAGTTAATGGGTCTCTCATTTCCTGAACGTC
TAGGCAGGCCTATC

517 GCCTTTCTAATCGAGCAGATATTGATGGACTGAACACGATGTGTAT
ATGGAGCGTGCTTT

518 TTAAAGGGCTGAAGAGAAGTCGATCGGTGTACGTTGTTGTCGTCAG
GTTGCAGGTTCGAA

519 TAATTGCCCCGCTGTGGACATATAAATATCATGTCCGTTGGTGTGA
GTAGATATCATGTC

520 TTTCGATAATTCAATTTCCGACGCGGTCAGAACCAAGCTGAGGCAA
ATGCGAGATGTCAT

521 ACTGTTGGTGAAATATGTGATGCCAAATGCTAGGAAAAATTATTT
AGATATTATTGCAT

522 ATTTTACGGAGAGCATAAGCTATAAAAGCAAATCGGTCTGCAGTGT
ATTATCGACATCCC

523 CTTCTTACTGCTTCAGCTCTACAAATTAGTGTGGGGGGCGAGCAGT
CGAGCCTATAAGTT

524 CACTTGGCACCCTGCGGACACAAGTCCTAGGTTTAATCGCATATGT
TGGCGTGACTAGAT

525 TGACTGATTTGCTTGGCACTCCGTCAACAGAAACACTTTCTAGGAT
CCGCAATGAGAAGG

TABLE 4-continued

Cell Signaling Oligonucleotide Sequences

| SEQ ID NO | Sequence |
|---|---|
| 526 | GCATGTCAGTTTTAAGAGACAAGCACCCTGCTATTGCTCTGTATGATTTATTAGTGAACC |
| 527 | AGCTTGCACCAACGTAGGTCACCAGTTAATATGCATTCTTCTTTCAGAAATTCAAGGAAG |
| 528 | ATAAGTTTGTAGCTATCAACATGACTAAGCTTTAGTGAAGGGCTATACAATGCATCTTTA |
| 529 | GGAGGCTATTGGTTAATACATATAAAGGGTGGTAAAGCGCTGTTCATATTTTTCCTAGAA |
| 530 | GGAAGAACTTTGCGTTTCCCTGCATTTCTACTTGTACCCTTATTCATTCATTCAAGAAAA |
| 531 | ATCTTGATTACTTGGCAGTCCTTTCTAGATACAATCCTTTCGAGGCATTTATATTCATTT |
| 532 | GTGCTGTAGATATGTTCAAGAGACAATTTGCTCATCTAGAGGAACACTATAGTAAAGGTG |
| 533 | CCAGAACCTACTAAACTGGATGCTAAATGAGCCAGACGTTCCAAATAATAGACAGTTAAC |
| 534 | AGACCTCTTAATCCATGGTGAGAGCATGAGGTCTAATAAGTTCGGAACCGTGTATTCATC |
| 535 | AAGTAACATTTTGTGCAGACAGTGGTTACAACTTTGAAAATTGGAAGCTGGGCTATTTTC |
| 536 | TTTTCGAAAGCTCATCGAGCAGCTATAGAAACATTAATGCATGAAAGAGATCTAAATATT |
| 537 | TGCAAATTAGTACCATTCGACAGCTGCCACCTGCCCATTGTTTGATTCCACGTGGCACAG |
| 538 | TTTGAAGTGAGTAACACCTAGACATGACATTGTACAACTTAAAGAACAATAGAAATTTGC |
| 539 | TTTACAGTTGTAGTTGTTTGCACGAATTGTTGAGTAACTTCTTTACTCATTTGAGGGTTT |
| 540 | TTGATCTTATGGATCTGACAAACAATGCACTGATTTATTCGTATGAGACCAAAAAATCTC |
| 541 | GATGATCCAAGGTATCTCGTCATGTCCTTAAGAGCTTGGTTTCTCTTTCTATCCCAGTTT |
| 542 | GCAAATGAACAGCCTGGCAGATTCCTAGTCTGGAATTAGGCAGTAAATAGTTATTTAATT |
| 543 | ACATCTAAGTGGTTTATGTACATATAAGAAACTGGCATGTTTATGAGTGGAACAACTTT |
| 544 | CTGTAAAACTTATCTTTGTATATAACAAGATTGAGCATGCCTAGAATAGAAAGAACAATT |
| 545 | TTAATCAAATCTGCAGTGTTAACCACCTGTTATCTACATGGGATTCTTACAAGCTATTCT |
| 546 | AAGTGGTTATGATTATCCAAAGTTCGTATCCGCAGATTACATGACAGTGTATGCTGCGCA |
| 547 | AAGATGAGATGTAGAGATGGATAAAGTTTGAATATATCTCAAAGCACGGCCTTGAGTTTT |
| 548 | AATTAATACCGGTTGAGTTTGTTCGGTTACACAATATATGACTTCATGATTAGCCATTTA |
| 549 | AAATGTCGGGTCGCAGAAATCCGCTGTTGAATATCCCAATTCCTGCTCGGCAACAGACTC |
| 550 | AGAGCGAGTCTTTTATAACAGGTTATTTTATTGTAAGAAAGCACACTTGTTTATGTGTAA |
| 551 | TCCACATGCACGGTCCAGTCCTCAGTGTTCACCCATAAGGACACCCCATGTTTGTTAATG |
| 552 | AATGCTCGGACACAGTAAATTAAATTCACTCGAGAATAAGTTCCTCGCCATTCACAATAA |
| 553 | CTTAGGCTTGAGCCCTAGATGCTGTACACAGAGCAGAATAATAGTGATGTATTAAGTAAT |
| 554 | GGATATCTGAGGTATTGATGTTGTACGATCCTCAGATCTACCTTTGATGCGTTATGCTGA |
| 555 | GAACTATGCTTTAACCTCTTTCAAATGTGTTTGTCAAATGCTTTCATAGCTTTATATATT |
| 556 | ATCATAATAGACATTCAAGTGATGACACCCTATGGTAAAACAATGGTTTCCAGATTCCAT |
| 557 | AAATAAAGTATAGAATATTACAGTATGTCCACTCACTCTTCCAGGGTTTCCCCGATGGAT |
| 558 | TATGGTTCAGTATCAAGCCCAAAAGGGACAACAACCATGCAGTCCCTCTGTACTGTAAGA |
| 559 | CAGTGTAGAGCATCTTCAGGCACAAGGACTACAGTATTACGGCGGATGATCAGTATAGCT |
| 560 | CAAAAAGTTTTGGAGTAATTGAGTAAATTATCCAATATGGTATTTGACCTCCTAAACAAA |
| 561 | GTTTTCTCAAAGTCGTAATAAATTTGTTTAGAAATTGTTGTACTGTTAATGCCCAACCGG |
| 562 | CATTTTATCAATTAGAAGGACAACTTTTATGAAAGCAGGATAATTCTAGGTGTAGTGCTA |
| 563 | TTTTCAAGTTTTTAAGACAGTTAAATACTCCTATCCTGTGGTGTCTGGATAAACATACCA |
| 564 | TGTGTAATCCATTAGCAAGGTCCTTGACAGCATTTTAAGCTGTAAGTTTAGAAGGTTTCA |
| 565 | TATGCTTGAATTTAAGTAGATTGGAGCTGTGAGACAGATGATTATATTCTCGACTTTTCT |
| 566 | TTTATTCATTTTAGTGAGTGGAAGGAGAGGACATTTTTATGGGTCTGCCACAGAAATTGA |
| 567 | TGAACAAGCACCAAAGTTTGGTAGTTGGAAAGACTAAATGAAATCATTATGAGTATATTC |
| 568 | CATTTGCATATTTAGAGGATATTCAAATGAGATTTATGAAGACATATGGCCGTGTGGCTC |
| 569 | ATGTTCCATGCCTAACAGGTATTGAGATTCAGGTCTATGTAGTAGTTTATCGTATACATC |
| 570 | GCTGCAGATAAGTCCCTTTACATTAAATGATTGGAAATTCTATACCCGGCTAAATGTTGT |
| 571 | TATTTTCAGGGAAAATGTCGCCTGCGGAGTCTTCTCGTGAAGAAAGTGTGTATATGGCCA |
| 572 | TTTATGTACTTTGAGTGTCTGACTAGAGAAGCATCATCGCTAGAATTAAGGAGGATGCCT |
| 573 | AATTTTTCGTTATTCAATGCATGTTTTCTCCTTACAGGAATTGCGAGCCTCTCGAGTCTT |

TABLE 4-continued

Cell Signaling Oligonucleotide Sequences

| SEQ ID NO | Sequence |
|---|---|
| 574 | AATCTCATCCAGCCGTTCTCACATCAAATCTTGCGAACTCGGAAATTAGCGTTCAATATA |
| 575 | TGCCATGTGTTTAAGATTTCCGCATGTATACCGGCACTATTAACATATGCAAGTATTCAT |
| 576 | TAATTTCTATACGTAGTACGTTTTTGAGATTTTGTGTGTTATAAAGCCACATGTTATGCT |
| 577 | GATGTTTCCGTATGCATTTATTGTCTCGGAAGTCTTGTTATTTCTAGGCTTTTGTTCTTC |
| 578 | TATGGACTTACTCGCAAGCAGCTCGACCGTGATATCTGGGTATAACTAACTAGCTATAAA |
| 579 | TCTAGAGAACTATTCAAGGTATTTGAGTGGAAACTATAACTATAAGATAGCTGTAGGTGT |
| 580 | CTGTAAATATAGATTTGTGGTGGCACGAAGAGGCTTCGAATAATGTGACCTTCATGTTTT |
| 581 | GGATATTACTATCTCAAATTGTCGGTTCCCGTGTGCGCTCTTTCGTGCTGCCTAGTTTAA |
| 582 | CTTTTGTCACCATTCTTGTATGACTTGTAAACAGTACGCAGATTCGATATCCTATTCGGC |
| 583 | TGTATATTACGCAGAGGATTTGTCCATCTATAACATGATCGTCGATCGTCACTACTTTAC |

TABLE 7

Nucleotide Sequence of the DNA Construct pWVR202

| SEQ ID NO | Sequence |
|---|---|
| 584 | CGCCGGCGTTGTGGATACCTCGCGGAAAACTTGGCCCTCACTGACAGATGAGGGGCGGACGTTGACACTTGAGGGGCCGACTCACCCGGCGCGGCGTTGACAGATGAGGGGCAGGCTCGATTTCGGCCGGCGACGTGGAGCTGGCCAGCCTCGCAAATCGGCGAAAACGCCTGATTTTACGCGAGTTTCCCACAGATGATGTGGACAAGCCTGGGGATAAGTGCCCTGCGGTATTGACACTTGAGGGGCGCGACTTGACAGATGAGGGGCGCGATCCTTGACACTTGAGGGGCAGAGTGCTGACAGATGAGGGGCGCACCTATTGACATTTGAGGGGCTGTCCACAGGCAGAAAATCCAGCATTTGCAAGGGTTTCCGCCCGTTTTTCGGCCACCGCTAACCTGTCTTTTAACCTGCTTTTAAACCAATATTTATAAACTTGTTTTTAACCAGGCTGCGCCCTGTGCGCGTGACCGCGCACGCCAAGGGGGTGCCCCCCCTTCTCGAACCCTCCCGGCCCGCTAACGCGGGCCTCCCATCCCCCAGGGGCTGCGCCCTCGGCCGCGAACGGCCTCACCCCAAAAATGGCAGCGCTGGCAGTCCATAATTGTGGTTTCAAAATCGGCTCCGTCGATACTATGTTTATACGCAACTTTGAAAACAACTTTGAAAAACGTGTTTTCTGGTATTTAAGGTTTTAGAATGCAAGGAACAGTGAATTGGAGTTCGTCTTGTTATAATTAGCTTCTTGGGGTATCTTTAAATACTGTAGAAAAGAGGAAGGAAATAATAAATGGCTAAAATGAGAAATTACCAGAATTGAAAAAACTGATCGAAAAATACCGCTGCGTAAAAGATACGGAAGGAATGTCTCCTGCTAAGGTATATAAGCTGGTGGGAGAAATGAAAACCTATATTTAAAAATGACGGACAGCCGGTATAAAGGGACCACCTATGATGTGGAACGGGAAAAGGACATGATGCTATGCTGGAAGGAAAGCTGCCTGTTCCAAAGGTCCTGCACTTTGAACGGCATGATGGCTGGAGCAATCTGCTCATGAGTGAGGCCGATGGCGTCCTTTGCTCGGAAGAGTATGAAGATGAACAAAGCCCTGAAAAGATTATCGAGCTGTATGCGGAGTGCATCAGGCTCTTTCACTCCATCGACATATCGGATTGTCCCTATACAGAATACTTAGACAGCCGTTAGCCGAATTGGATTACTTACTGAATAACGATCTGGCCGATGTGGATTGCGAAAACTGGGAAGAAGACACTCCATTTAAAGATCCGCGCGAGCTGTATGATTTTTAAAGACGGAAAAGCCCGAAGAGGAACTTGTCTTTTCCCACGGCGACCTGGGAGACAGCAACATCTTTGTGAAAGATGGCAAAGTAAGTGGCTTTATTGATCTTGGGAGAAGCGGCAGGCGGACAAGTGGTA |
| | TGACATTGCCTTCTGCGTCCGGTCGATCAGGGAGGATATCGGGGAAGAACAGTATGTCGAGCTATTTTTTGACTTACTGGGGATCAAGCCTGATTGGGAGAAAATAAAATATTATATTTTACTGGATGAATTGTTTTAGTACCTAGATGTGGCGCAACGATGCCGGCGACAAGCAGGAGCGCACCGACTTCTTCCGCATCAAGTGTTTTGGCTCTCAGGCCGAGGCCCACGGCAAGTATTTGGGCAAGGGGTCGCTGGTATTCGTGCAGGGCAAGATTCGGAATACCAAGTACGAGAAGGACGGCCAGACGGTCTACGGGACCGACTTCATTGCCGATAAGGTGGATTATCTGGACACCAAGGCACCAGGCGGGTCAAATCAGGAATAAGGGCACATTGCCCCGGCGTGAGTCGGGGCAATCCCGCAAGGAGGGTGAATGAATCGGACGTTTGACCGGAAGGCATACAGGCAAGAACTGATCGACGCGGGGTTTTCCGCCGAGGATGCCGAAACCATCGCAAGCCGCACCGTCATGCGTGCGCCCCGCGAAACCTTCCAGTCCGTCGGCTCGATGGTCCAGCAAGCTACGGCCAAGATCGAGCGCGACAGCGTGCAACTGGCTCCCCCTGCCCTGCCCGCGCCATCGGCCGCCGTTGGAGCGTTCGCGTCGTCTCGAACAGGAGGCGGCAGGTTTGGCGAAGTCGATGACCATCGACACGCGAGGAACTATGACGACCAAGAAGCGAAAAACCGCCGGCGACCTGGCAAAACAGGTCAGCGAGGCCAAGCAGGCCGGTTGCTGAAACACACGAAGCAGCAGATCAAGGAAATGCAGCTTTCCTTGTTCGATATTGCGCCGTGGCCGGACACGATGCGAGCGATGCCAAACGACACGGCCCGCTCTGCCCTGTTCACCACGCGCAACAAGAAAATCCCGCGCGAGGCGCTGCAAAACAAGGTCATTTTCCACGTCAACAAGGACGTGAAGATCACCTACACCCGGCGTCGAGCTGCGGGCCGACGATGACGAACTGGTGTGGCAGCAGGTGTTGGAGTACGCGAAGCGCACCCCTATCGGCGAGCCGATCACCTTCACGTTCTACGAGCTTTGCCAGGACCTGGGCTGGTCGATCAATGGCCGGTATTACACGAAGGCCGAGGAATGCCTGTCGCGCCTCACAGGCGACGGCGATGGGCTTCACGTCCGACCGCGTTGGGCACCTGGAATCGGTGTCGCTGCTGCACCGCTTCCGCGTCCTGGACCGTGGCAAGAAAACGTCCCGTTGCCAGGTCCTGATCGACGAGGAAATCGTCGTGCTGTTTGCTGGCGACCACTACACGAAATTCATATGGGAGAAGTACCGCAAGCTGTCGCCGACGGCCCGACGGATGTTCGACTATTTCAGCTCGCACCGGGAGCCGTACCCGCTCAAGCTGGAAACCTTCCGCCTCATGTGCGGATCGGATTCCACCCGCGTGAAGAAGTGGCGCGAGCAGGTCGGCGAAGCCTGCGAAGAGTTGCGAGGCAGCGGCCTGGTGGAACACGCCTGGGTCAATGATGACCTGGTCATTGCAAACGCTAGGGCCTTGTGGGGTCAGTTCCGGCTGGGGGTTCAGCAGCCAGCGCTTTACAAAGGAGTCTAGAAGATCCTGGCATTTCAGGAACAAGCGGGCACTGCTCGACGCACTTGCTTCGCTCAGTATCGCTCGGGACGCACGGCGCGCTCTACGAACTGCCGATAGACAACTGTCACGGTTAAGCGAGAAATGAATAAGAAGGCTGATAATTCGGATCTCTGCGAGGGAGATGATATTTGATCACAGGCAGCAACGCTCTGTCATCGTTACAATCAACATGCTACCCTCCGCGAGATCATCCGTGTTTCAAACCCGGCAGCTTAGTTGCCGTTCTTCCGAATAGCATCGGTAACATGACAAAGTTGCCCGCCTTACAACGGCTCTCCCGCTGACGCCGTCCCGGACTGATGGGCTGCCTGTATCGAGTGGTGATTTTGTGCCGAGCTGCCGGTCGGGGAGCTGTTGGCTGGCTGGTGGCAGGATATATTTGTGGTGTAAACAAATTGACGCTTAGACAACTTAATAACACATTGCGGACGTTTTTAATGTACTGGGGTGGTTTTTCTTTTCACCAGTGAGACGGGCAACAGCTGATTGCCCTTCACCGCCTGGCCCTGAGAGAGTTGCAGCAAGCGGTCCACGCTGGTTTGCCCCAGCAGGCGAAAATCCTGTTTGATGGTGGTTCCGAAATCGGCAAAATCCCTTATAAATCAAAGAATAGCCCGAGATAGGGTTGAGTGTTGTTCCAGTTTGGAACAAGAGTCCACTATTAAAGAACGTGGACTCCAACGTCAAAGGGCGAAAAACCGTCTATCAGGGCGATGGCCCACGGCCGCTCTAGAACTAGTGGATCCCCCCTACGTGCGATCTAGTAACATAGATGACACCGCGCGCGATAATTTATCCTAGTTTGCGCGCTATATTTTGTTTTCTATCGCGTATTAAATGTATAATTGCGGGACTCTAATCATAAAAACCCATCTCATAAATAACGTCATGCATTACATGTTAATTATTACATGCTTAACGTAATTCAACAGAAATTATATGATAATCATCGCAAGACCGGCAACAGGATTCAATCTTAAGAAACTTTATTGCCAAATGTTTGAACGATCCCTCAGAAGAACTCGTCAAGAAGGCGATAGAAGGCGATGCGCTGCGAATCGGGAGCGGCGATACCGTAAAGCACGAGGAAGCGGTCAGCCCATTCGCCGCCAAGCTCTTCAGCAATATCACGGGTAGCCAACGCTATGTCCTGATAGCGGTCCGCCACACCCAGCCGGCCACAGTCGATGAATCCAGAAAAGCGGCCATTTTCCACCATGATATTCGGCAAGCAGGCATCGCCATGGGTCACGACGAGATCCTCGCCGTCGGGCATGCGCGCCTTGAGCCTGGCGAACAGTTCGGCTGGCGCGAGCCCCTGATGCTCTTCGTCCAGATCATCCTGATCGACAAGACCGGCTTCCATCCGAGTACGTGCTCGCTCGATGCGATGTTTCGCTTGGTGGTCGAATGGGCAGGTAGCCGGATCAAGCGTATGCAGCCGCCGCATTGCATCAGCCATGATGGATACTTTCTCGGCAGGAGCAAGGTGAGATGACAGGAGATCCTGCCCCGGCACTTCGCCCAATAGCAGCCAGTCCCTTCCCGCTTCAGTGACAACGTCGAGCACAGCTGCGCAAGGAACGCCCGTCGTGGCCAGCCACGATAGCCGCGCTGCCTCGTCCTGGAGTTCATTCAGGGCACCGGACAGGTCGGTCTTGACAAAAAGAACCGGGCGCCCCTGCGCTGACAGC |

TABLE 7-continued

Nucleotide Sequence of the DNA Construct pWVR202

SEQ ID NO Sequence

CGGAACACGGCGGCATCAGAGCAGCCGATTGTCTGTTGTGCCCAGTC
ATAGCCGAATAGCCTCTCCACCCAAGCGGCCGGAGAACCTGCGTGCA
ATCCATCTTGTTCAATCATCTGTTAATCAGAAAAACTCAGATTAATC
GACAAATTCGATCGCACAAACTAGAAACTAACACCAGATCTAGATAG
AAATCACAAATCGAAGAGTAATTATTCGACAAAACTCAAATTATTTG
AACAAATCGGATGATATTTATGAAACCCTAATCGAGAATTAAGATGA
TATCTAACGATCAAACCCAGAAATCGTCTTCGATCTAAGATTAACA
GAATCTAAACCAAAGAACATATACGAAATTGGGATCGAACGAAAACA
AAATCGAAGATTTTGAGAGAATAAGGAACACAGAAATTTACCTTGAT
CACGGTAGAGAGAATTGAGAGAAAGTTTTTAAGATTTTGAGAAATTG
AAATCTGAATTGTGAAGAAGAAGAGCTCTTTGGGTATTGTTTATAG
AAGAAGAAGAAGAAAAGACGAGGACGACTAGGTCACGAGAAAGCTAA
GGCGGTGAAGCAATGACTAATAATAAAATGACACGTGTATTGAGCGT
TGTTTACACGCAAAGTTGTTTTTGGCTAATTGCCTTATTTTTAGGTT
GAGGAAAAGTATTTGTGCTTTGAGTTGATAAACACGACTCGTGTGTG
CCGGCTGCAACCACTTTGACGCCGTTTATTACTGACTCGTCGACAAC
CACAATTTCTAACGGTCGTCATAAGATCCAGCCGTTGAGATTTAACG
ATCGTTACGATTTATATTTTTTAGCATTATGTCGTTTTATTTTTTAAA
TATACGGTGGAGCTGAAAATTGGCAATAATTGAACCGTGGGTCCCAC
TGCATTGAAGCGTATTTCGTATTTTCTAGAATTCTTCGTGCTTTATT
TCTTTTCCTTTTTGTTTTTTTTGCCATTTATCTAATGCAAGTGGGC
TTATAAAATCAGTGAATTTCTTTGGAAAAGTAACTTCTTTATCGTATA
ACATATTGTGAAATTATCCATTTCTTTTAATTTTTTAGTGTTATTGG
ATATTTTTGTATGATTATTGATTGCATAGGATAATGACTTTTGTAT
CAAGTTGGTGAACAAGTCTCGTTAAAAAAGGCAAGTGGTTTGGTGAC
TCGATTTATTCTTGTTATTTAATTCATATATCAATGGATCTTATTTG
GGGCCTGGTCCATATTTAACACTCGTGTTCAGTCCAATGACCAATAA
TATTTTTTCATTAATAACAATGTAACAAGATGATACACAAACATT
CTTTGAATAAGTTCGCTATGAAGAAGGGAACTTATCCGGTCCTAGAT
CATCAGTTCATACAAACCTCCATAGAGTTCAACATCTTAACAAGGA
TATCCTGATCCGTTGACGGCGCGCCAAGCGGCCGCAAAACCCCTCAC
AAATACATAAAAAAAATTCTTTATTTAATTATCAAACTCTCCACTAC
CTTTCCCACCAACCGTTACAATCCTGAATGTTGGAAAAAACTAACTA
CATTGATATAAAAAAACTACATTACTTCCTAAATCATATCAAATTG
TATAAATATATCCACTCACTTGGACAAATTGCCCATAGTTGGAAAGA
TGTTCACCAAGTCAACAAGATTTATCAATGGAAAAATCCATCTACCA
AACTTACTTTCAAGAAAATCCAAGGATTATAGAGTAAAAAATCTATG
TATTATTAAGTCAAAAAGAAAACAAAGTGAACAAATATTGATGTAC
AAGTTTGAGAGGATAAGACATTGGAATCGTCTAACCAGGAGGCGGAG
GAATTCCCTAGACAGTTAAAAGTGGCCGGAATCCCGGTAAAAAAGAT
TAAAATTTTTTGTAGAGGGAGTGCTTGAATCATGTTTTTTATGATG
GAAATAGATTCGACCATCAAAAACATTCAGGACACCTAAAATTTT
GAAGTTTAACAAAAATAACTTGGATCTACAAAAATCCGTATCGGATT
TTCTCTAAATATAACTAGAATTTTCATAACTTTCAAAGCAACTCCTC
CCCTAACCGTAAAACTTTTCCTACTTCACCGTTAATTACATTCCTTA
AGAGTAGATAAAGAAATAAAGTAAATAAAAGTATTCACAAACCAACA

ATTTATTTCTTTTATTTACTTAAAAAAACAAAAAGTTTATTTATTTT
ACTTAAATGGCATAATGACATATCGGAGATCCCTCGAACGAGAATCT
TTTATCTCCCTGGTTTTGTATTAAAAAGTAATTTATTGTGGGGTCCA
CGCGGAGTTGGAATCCTACAGACGCGCTTTACATACGTCTCGAGAAG
CGTGACGGATGTGCGACCGGATGACCCTGTATAACCCACCGACACAG
CCAGCGCACAGTATACACGTGTCATTTCTCTATTGGAAAATGTCGTT
GTTATCCCGCTGGTACGCAACCACCGATGGTGACAGGTCGTCTGTT
GTCGTGTCGCGTAGCGGGAGAAGGGTCTCATCCAACGCTATTAAATA
CTCGTCTCCACCGCGTTACTTCTCATCTTTTCTCTTGCGTTGTATAA
TCAGTGCGATATTCTCAGAGAGCTTTTCATTCAAAGGTATGGAGTTT
TGAAGGGCTTTACTCTTAACATTTGTTTTTCTTTGTAAATTGTTAAT
GGTGGTTTCTGTGGGGAAGAATCTTTTGCCAGGTCCTTTTGGGTTT
CGCATGTTTATTTGGGTTATTTTTCTCGACTATGGCTGACATTACTA
GGGCTTTCGTGCTTTCATCTGTGTTTTCTTCCCTTAATAGGTCTGTC
TCTCTGGAATATTTAATTTTCGTATGTAAGTTATGAGTAGTCGCTGT
TTGTAATAGGCTCTTGTCTGTAAAGGTTTCAGCAGGTGTTTGCGTTT
TATTGCGTCATGTGTTTCAGAAGGCCTTTGCAGATTATTGCGTTGTA
CTTTAATATTTTGTCTCCAACCTTGTTTATAGTTTCCCTCCTTTGATC
TCACAGGAACCCTTTCTTCTTTGAGCATTTTCTTGTGGCGTTCTGTA
GTAATATTTTAATTTTGGGCCCGGGTTCTGAGGGTAGGTGATTATTC
ACAGTGATGTGCTTTCCCTATAAGGTCCTCTATGTGTAAGCTGTTAG
GGTTTGTGCGTTACTATTGACATGTCACATGTCACATATTTTCTTCC
TCTTATCCTTCGAACTGATGGTTCTTTTTCTAATTCGTGGATTGCTG
GTGCCATATTTTATTTCTATTGCAACTGTATTTTAGGGTGTCTCTTT
CTTTTTGATTTCTTGTTAATATTTGTGTTCAGGTTGTAACTATGGGT
TGCTAGGGTGTCTGCCCTCTTCTTTGTGCTTCTTTCGCAGAATCTG
TCCGTTGGTCTGTATTTGGGTGATGAATTATTTATTCCTTGAAGTAT
CTGTCTAATTAGCTTGTGATGATGTGCAGGTATATTCGTTAGTCATA
TTTCAATTTCAAGCGATCCCCCGGGCTGCAGGCTAGCTAAAAGTACT
TTTCCTAGGATCGATGGGTGTTATTTGTGGATAATAAATTCGGGTGA
TGTTCAGTGTTTGTCGTATTTCTCACGAATAAATTGTGTTTATGTAT
GTGTTAGTGTTGTTTGTCTGTTTCAGACCCTCTTATGTTATATTTTT
CTTTTCGTCGGTCAGTTGAAGCCAATACTGGTGTCCTGGCCGGCACT
GCAATACCATTTCGTTTAATATAAAGACTCTGTTATCCGTGAGCTCG
AATTTCCCCGATCGTTCAAACATTTGGCAATAAAGTTTCTTAAGATT
GAATCCTGTTGCCGGTCTTGCGATGATTATCATATAATTTCTGTTGA
ATTACGTTAAGCATGTAATAATTAACATGTAATGCATGACGTTATTT
ATGAGATGGGTTTTTATGATTAGAGTCCCGCAATTATACATTTAATA
CGCATAGAAAACAAAATATAGCGCGCAAACTAGGATAAATTATCGC
GCGCGGTGTCATCTATGTTACTAGATCGCGGCCGCATTTAAATGGGC
CCTGTTAACTGGTACCTTAATTAAAAGTTTAAACTATCAGTGTTTGA
CAGGATATATTGGCGGGTAAACCTAAGAGAAAAGAGCGTTTATTAGA
ATAATCGGATATTTAAAAGGGCGTGAAAAGGTTTATCCGTTCGTCCA
TTTGTATGTGCATGCCAACCACAGGGTTCCCCAGATC

TABLE 15

Summary of results for cell signaling genes in transformants

| DNA Construct | Putative Cell Signaling Gene | SEQ ID NO | Increased regenerative ability of P. deltoids transformants after 12 weeks (example 16, table 10) | Increase in regenerative ability of P. deltoids transformants after 5 months (Example 16, table 11) | P. deltoids plants displaying growth increases of >50% (example 20) | E. grandis x E. europhylla plants with mean growth increases when compared to controls and with increases of >50% (example 23) | P. taeda plants with growth increases when compared to controls and with increases of >50% (example 25) | Other observations |
|---|---|---|---|---|---|---|---|---|
| 1 pGrowth1 | Poly-phosphoinositide binding protein | 130 | NT | NT | NT | NT | yes | Patterned necrosis in P. deltoids (example 21) |
| 2 pGrowth2 | Poly-phosphoinositide binding protein | 132 | NT | NT | — | NT | — | Patterned necrosis in P. deltoids (exampe 21) |

TABLE 15-continued

Summary of results for cell signaling genes in transformants

| | DNA Construct | Putative Cell Signaling Gene | SEQ ID NO | Increased regenerative ability of P. deltoids transformants after 12 weeks (example 16, table 10) | Increase in regenerative ability of P. deltoids transformants after 5 months (Example 16, table 11) | P. deltoids plants displaying growth increases of >50% (example 20) | E. grandis x E. europhylla plants with mean growth increases when compared to controls and with increases of >50% (example 23) | P. taeda plants with growth increases when compared to controls and with increases of >50% (example 25) | Other observations |
|---|---|---|---|---|---|---|---|---|---|
| 3 | pGrowth3 | Poly-phosphoinositide binding protein | 122 | NT | NT | — | NT | yes | |
| 4 | pGrowth11 | Ethylene-responsive elongation factor | 117 | — | yes | yes | NT | yes | |
| 5 | pGrowth21 | G-protein coupled receptor | 150 | — | yes | yes | NT | yes | |
| 6 | pGrowth22 | 14-3-3 protein | 180 | yes | yes | — | yes | NT | |
| 7 | pGrowth23 | 14-3-3 protein | 195 | — | — | — | NT | — | |
| 8 | pGrowth24 | 14-3-3 protein | 192 | yes | yes | yes | NT | NT | Increased leaf surface area in P. deltoids (example 17) |
| 9 | pGrowth25 | Synaptobrevin-like | 98 | — | yes | yes | NT | — | Longer internodes in P. deltoids (example 18) |
| 10 | pGrowth26 | Synaptobrevin-like | 140 | — | yes | yes | NT | NT | |
| 11 | pGrowth27 | Synaptobrevin-like | 155 | — | yes | yes | yes | NT | |
| 12 | pGrowth28 | Synaptobrevin-like | 124 | — | yes | — | NT | NT | |
| 13 | pGrowth29 | SNF1-related protein kinase | 113 | — | yes | NT | NT | NT | |
| 14 | pGrowth30 | Ethylene Receptor | 152 | yes | yes | yes | NT | yes | |
| 15 | pGrowth49 | Synaptobrevin like | 141 | NT | NT | NT | NT | NT | |
| 16 | pGrowth51 | Poly-phosphoinositide binding protein | 164 | NT | NT | NT | NT | NT | |

NT = not tested
— No effect observed

SEQUENCE LISTING (585 sequences)

SEQ ID NO: 1 - DNA, 1071 bp, Eucaluptus grandis
gcaagctaagctaagggagcggttaccctcgcgaaagcaagaacctttcagttcacgcagaagagagagaaagaaagagagagatggagagggagagagagcagcaggtttaccaggcgaggctcgcggagcaagccgagcgatacgatgagatggttgagtcgatgaagcaagtagctaagctggatgtggaactgactgttgaggagagaaatgtgttgtctgttgggtataagaatgtgattggggccagaagggcatcatggcggattttatcttccattgagcagaaggaggggaccaagggtaacgagcagaatgtgaagaggatcaaggactacaggcaaagggttgaagatgagctcgccaagatctgcagtgacatactctcagtcattgataagcatcttatcccatcctcctcaagtggagagtcgactgttttctactataagatgaaaggtgattattgtcgttaccttgctgaattcaaggctggtgatgaccgcaaagaagctgctgatcagtcgctcaaggcatatgaggctgccagttccactgcttcaacggatttggctccaactcaccctatcagacttggactggctttgaatttctccgtcttctattatgaaatcatgaactcgccagaaagggcatgccatctggctaaacaagcttttgatgaggctatcgcggaactcgatagcctaaatgaagactcctataaggacagtaccctcattatgcaacttcttagggacaatcttacactatggactacagatctgcctgaagaaggaggtgagcaatccaaagttgatgagcctgcggcagagagttaattgggcaaagtagacgcttcctgatgatttcaattctttgggggacattgaggcttgctagggcaggagtcatggtcttatgcgatggtgcagttagtagactgttggtctgtatttacttatttaacagaatgcttctccacagtgttgtgtttgtgctggttacacgattgaatactgttatctttgtcctataaaacacggaagccttttctcaaaaaaaaaa

SEQ ID NO: 2 - DNA, 1214 bp, Eucaluptus grandis
ggagaagcgccttttttttcctttctctctcccttgctttcgtttctccatttgtggtttttccgttttttccacgtcgctcccagcggatacgcgtcttccgccacctcatctcgccccgccgtataaattcggagtcctccctggcgcactcccctctcgcgtccgtccgcaaaacactccccccgcccgcagctcgctccgcccggctttttctcgctcgctcgctcgcgattcttgctcttccgcaaatccctagtcgagagttaggtttcgtaacagtacacggaagatgtcgccctctgattcttcacgggaggaatatgtgtacatggccaagttagctgaacaggctgagcggtacgaggagatggtggatttcatggagaaagttgccaagactgtagacgtcgaggagctaaccgttgaggaacgtaaccttttgtctgtggcgtacaagaatgtgattggggccaggagggcatcgtggaggatcatttcttccattgagcagaaggaagagagcaggggtaacactgatcatgtctcgatcattaaggactacaggggaaagatcgagtccgagctcagcaagatctgtgaaggcattctcagccttcttgagtcgcatctcattccttcagcctcctctgctgagtccaaggtgttttaccttaagatgaaaggtgattaccacaggtatctggcagagtttaagactgcgactgaaaggaaagaagctgccgagagcactttattggcctacaaatctgctcaggatattgctggggccgaactggcttctactcacccaattaggctgggacttgcgctgaacttctctgttttctactatgaaatacttaactctcctgatcgggcttgcgctcttgcaaagcaggcatttgatgaggccatcgctgagttggatacgctgggcgaggaatcatacaaggacagtacattgatcatgcaacttcttcgagataacttgactctgtggacttctgatctcacggatgaagctggggatgacattaaggaagcttcgaaactggagtctggagaggggcagcaatgatttgctaggatgatgtcagtactttaatgatattttgcaccgtcgtagatgccttgtggtttgtcacagtgaagattatttatgaactgagagtgctataagttgtttctctagtgttccttgaaaaaaaaaa

SEQ ID NO: 3 - DNA, 1657 bp, Eucaluptus grandis
caaaagcaatctacatttctttctttgattaccaggacaaataaaataagatgctataccagagcagtatcagtgttacacaagaatcaaataggatttggcacctcaaaggcagataaattgattaaatggccacaaattggaaagcatcattcaaaagataagtcacaagagctcctcaaacctgaacaataaattatattcaccatgaccacagcaatgagcatcacatgattgagaatctcgttgcacaagcccacaagacaggtgaactatcaatctgactttcttggccatccaaagcagtgattcctcattgtaaaaatttaatcaatcttttgctattaggcaattcttccatagtcttttcttccacgagttgttggaggtatgtttgtgaaagcatcactggcccttcgcccccactctcgctcacctccgaacgagagagtcccaatcattcgcagcttcgcagcttttgtaatttgatcagcacgttgaagatggcggcagctgattcttcacgcgaggaaaatgtgtacatggccaagttggctgaacaggccgagcgttatgaggaaatggtggaatttatggagaaagtggccaagacggttgatgtcgaggagcttactgttgaggaacgtaacctcctctccgtggcatacaagaatgtgattggtgccaggagggcttcatggaggatcatctcttccattgagcagaaggaagagagcaggggaaatgaggaccatgttgtgattatcaaggagtatagggggaagattgagactgagctcagcaagatctgtgatggcatcctcaatctccttgagtcgcatctcgttccatcagcctcatctgctgagtcaaaggtgttctatctgaagatgaagggtgattaccacaggtacttggctgagtttaaggcgggaactgagaggaaagaggctgctgagagcaccttgttggcttataaatctgctcaggatattgctttggctgagctggctcccactcaccctattaggcttggacttgctcttaacttctctgtgttctattatgaaattctcaactcacctgatcgtgcctgcagtctggctaaacaggcatttgatgaggctatctccgagctagatacattgggtgaggaatcatacaaggacagcacattgattatgcaacttctccgagataacctaacactctggacttccgatgtcacggatgaagctggagatgagatcaaggaatcttcaaaaagggagtctggtgaggggcagccaccacagtgacgagctccattcgaagatggcttctctgtactttaagactgtgaactcttatgtaggcagcgctttgttataacatcatttggtcagcaccatgatcttagtacttgcactgcttttgggtgaaagtattatgggactgtgtacttttctctggttagttatgggaagagattgacttgatgcagtgctctgttttgtctcgtggtagtgatgtcagtggttttcttattgtgaagtgaataattctatagactcacactaccaatggttcacaaagtgattgtggtagacatatgtcgagtgctttaattggttcgccgtttcatgtcaaatgctatcaccttttgccaaaaaaaaaa

SEQ ID NO: 4 - DNA, 1253 bp, Eucaluptus grandis
gcgtcgtcctccttcctcctcccccttcctcaccagccagtcgtcgtctgcttgagggctagagagagagagagagtagagagagagtagagagagagtgtagagagagagagagagagagaaggagatggcgtcgacgaaggagagagacggctacgtctacgtcgccaagctcgccgagcaggccgagcgctacgacgaaatggtggaggccatgaagaatgtggcgaagctcgatgtggagctgacggtggaagagaggaacctgctctccgtcggttacaagaacgtgatcggcgcgcggcgggcgtcgtggaggatcctctcttccatcgagcagaaggaggactcgaaagggaacgagcataatgtgaagaagatcaaggagttcaggcagaaggtcgaggccgagctggcgaatatctgcggggatgtgatgaaggtgatcgatgagcatttgattccttcgtgtgctggtggagaatcgaccgtgtttttctataaaatgaaaggagattactatcggtacttggcagagtttaaggctggtgatgacagaaaggaggcagctgatcagtctatgaaagcatatgagctggcttccaccaccgcagaggctgacctatccccgacacatccaatcagattgggtttggcattgaacttttctgtcttctactatgagatcatgaactctcctgaaagggcctgtcaccttgcaaagcaggcttttgacgaagcgatctcagagttggatactttgagtgaggaatcctacaaagacagcacattaattatgcagcttctaagggacaatctgacattatggacttctgacatccctgaggatggagctgaagatgctcagaagcttgacaatgctgccaaagctgcaggaggtgaagatgcagagtgaggcagagtgttgcttgggagctcataaagggagtcaaatggtttgagggtggtgtttccttgtctgaaggcatattgagagacttttactttctgtttccttcacttttttcgtttcgtcgtcctcttttgcttcgacattgctactagctaattatttggtgcttgttctgtgctcccattctcacgtctgctgattaaacctgataaaaattatgtcaagacagtctgttgtacgatctaagtctgtttaattgagaatgtagcgttattagatgatgaatctcaacagttgtgcaatcggatgttaaggcctacttgttaatctaaaaaaaaaa

SEQ ID NO: 5 - DNA, 1634 bp, Eucaluptus grandis
aagagatggcagagcaccgcagctatggaaatgtgaatctaaagacgtttgatgctcatgttccggagattaagttcaccaagctcttcatcgacggcgagttcgtcgattctgtcaaaggaaggacattcgagacgaaagatccaagaaatggacaagtggtggcaagagtcgcggagggagacgaagaggacgtggagttggccgtgattgctgcccgtcgagcatttgatcacggcccttggccacgcatgcccggctatcaaaggggaaggatcatgtcaaaatttgcagacttgatcgaagagaacatagacgaactagctgctctggacactatagatgccgggaagctattcagtgtcggcaaggcccgggacattcctaacgctgccatgctgctgaggtactatgccggtgcggtggataagatccacggcgaggtattgaagatgtcgcgcgagcttcacgggtacacgctacgggagccggttggcgtgatcgggcacatcatcccttggaacttcccgaccggggtgttcttcatgaaggtcgccccaacactggcggctggttgcaccatgatcgtgaagcccgccgagcaaacccctctatcggctctcttttacgctcatttggctaagaaggctggtgttcctgatggagtgatcaatgtcgttaccggttttggaccgacagctggtgcagcgataagtagtcatatggacattgatatggttagttttacggggtctacaaaagtaggacacatggtgatgcaggccgcggcaacgagcaatttgaaacaagtgtcgcttgaattggggggcaaatcacctcttatagtctttgatgatgtcgatttagataccgctactaatcttgctctgactggtatcctctataacaagggagaagtatgcgtcgcaggatctcgtgtctatgttcaagaagcgatctatgaagaattcgagaagaagctagtggcaaaggccaaggcttggccggtcggtgacccatttgatccgaatgtccgtcaaggaccgcaggtcgataagaaacagtttgagaaaatactttcttacatcgagcatggaaagagagaaggagctacacttttgattgggggtgagcgtctaggcaccgaagggtactacattcagccaacaatcttcacagatgttaatgaggacaatgtgatcgtaaaggatgagattttcggccccgtcatgtcactcatgaaattcaagaccatggaggaggtgatcaagagggccaatgacacgaggtacggtctagcggcgggaattctgacaaagaacatagatctagcaaacacggtctcaaggtcaatccgagcaggtatgatttggataaattgctaccttgcagttgacaacgactgtccttatggtggctacaagatgagtggctttggcaaagatcttggcttggacgctctccacaaatacctacatgtcaaatctatcgtgacccccatttataactctccctggctttgagagagttttttttttcttagtgggcgctggattgcatcatcagacgggtcaaataatatataattagaagtgtatttgtttgagtgaaaatatttttcccgaaaaaaaaaa

SEQ ID NO: 6 - DNA, 1919 bp, Eucaluptus grandis
aggagagagacgagatggcagagaaccagagcgacgccaacgggagcctgaagacttatgatgaacacgttccggacatcaagtttaccaagctcttcatcaatggcgagttcgtcgattctgtcaaagggaggacgttcgagacgatagatccaagaaatggagaagttacagcaagagttgcagagggagacaaagaggacgtggatttggctgtgaaagccgcccgtcaagcatttgatcacggcccttggccacgcatgcccggctaccaaaggggaaggatcatgtcgaaatttgcggacttgatcgaagagaacatagatgaactggctgctctggacactatcgacgccgggaagatattcagcatgggcaaggccgtggacatccctcacgctgccacatgtctaaggtattatgccggcgcagcggacaagatccatggtgaggtgttgaagatgtcgcgtgaacttcatgggtacacgctgctggagccggttggcgtggtcgggcacattatcccttggaacttcccgaccagcatgttctttatgaaggtcgccccagcactggcggctggttgcaccatgatcgtgaagcctgccgagcagacccctctgtcggctctctattatgctcatttggctaagaaggccggtgttcctaatggagtgatcaatgttgtaactggtttcggaccaacggccggtgctgcaataaccagtcatatggacattgatatggtcaattttacggggtctacaaaagtggggcgcatcgtgatgcagactgcagcgacaagcaatttgaaacaagtgtcactcgaattaggcgggaaatcgcctattatgatatttgatgatgctgatttagatactgctaccgatcttgctctaataggtatcgtccataacaagggagaaatatgcgtcgcgggctctcgcgtttatgttcaggaagggatctatgaagagtttgagaagaagctggtggcaaaggcaaaggcttggccagtcggtgacccatttgatccgaaagtccaacaaggaccgcaggtcgataagaaacaatttgagaagatactttcttatatcgagcatggaaagagagaaggggccacgcttttgactgggggcgagcgtttgggcaccaaagggtactatgttcagccaacaattttcacaaatgttaaggaggacaatgtgatcgtgaaggatgagatttttggtcctgtcatgtcgctcatgaaattcaagactgtggaggaggcgatcaagagggctaacgatactaggtatggtctagcagcagggattgtgacgaagaatatagatgtggcgaacacagtctcgaggtcaattcgagcgggtgtcatatggataaactgctactttgcattcgacaatgactgtccttgtggtggttacaagacaagcggcttcgggagagatctcggtttggatgccctccacaaatgcctacatgttaaatctattgtgaccccgctttataactctccatggctttaagagaattttctaggaaaagagctttgagtcatatggtggctcaaataatgtgtaattccaaattatgaggtatatttgcaataaacaaaatgcaggtcattttggcaaaaaaaaaaaaaaaaaaaagcaagtgtcaaagccattctagtccacttgccttggtggaatgggtttgttgtgtattcttaaatgatctgccctactctctgctcctttgtcgtcttttatatatttttgatattggtaatgaggagatgaattcttctgtgtcctttgtatgtcttatagtctgatatcatcatgagtgatgaagttggtcgaagagcatattgtgcaaactgctaaacttgagttgtactatggggggtttacagtttaaaaaaaaaa

SEQ ID NO: 7 - DNA, 1718 bp, Eucaluptus grandis
ggattttgagtgcagagatgagagagagggagatggcagagaaccagagcaatgccaacgggagcctgaagacttatgatgctcatgttccagagattaaattcaccaagctcttcatcaatggcaagttcgtcgattctgtcaaagggaggacattggagacgatagatccaagaaatggacaagcgacggcgagagttgccgagggagacaaagaggacgtggatttggctgtcaaagctgcccgccaagcatttgatcacggcccctggccgcgcatgcccggctatcaaaggggaaggatcatgtcgaaatttgcggacttaatcgaagagaacatagacgaactagctgctctggacactatagatgccgggaagctatttagtgtcggcaaggcccaggacatccctcacgctgccacgatgctgaggtactatgcgggtgcagcggataagatccacggcgaggtattgaagatgtcgcgcgagcttcacgggtacacgctacgggagccggttggcgtgatcgcgcacatcatcccttggaacttcccgaccgcggtgttctttatgaaggtcgccccagcgctggcggctggttgcaccatgatcgtgaagcccgccgagcaaacccctctatcggctctcttttacgctcacttggctaagaaggccggtattcctgatggagtaatcaacattgtaactggttttggacggacagccggtgcggcgataagcaatcacatggacattgacatggttagttttacggggtctacagaagtgggacgcattgtaatgcaggccgcagcaacaagcaatttaaaacaagtgtcgctcgaattgggcgggaaatcacctcttataatttttgatgatgttgatttagatactgctactgatcttgctctaaccggtatcctccataacaagggagaaatatgtgttgcgggctctcgtgtctatgttcaagaagggatctatgaagagttcaagaacaagctagtggcaaaggcaaaggcttggccggtcggcgacccatttgatccgaatgtccgtcacggaccgcaagtcgataagaaacagtttgagaagatacttgcatacatcgagcatggaaagagagaaggagccacgcttttgactgggggcgagcgtctgggcaccgaaggttactacattcagccaacaatcttcacaaatgttaaggaggacaacatgattgtgaaggatgagattttcggccctatcatgtcgctcatgaaattcaagaccacggaggaggtgatcaagagggccaatgacacgaggtatggtctagcagcaggggttttgacgaagaacatagatatggcgaacacagtctcgaggtcaattcgagcaggcaccatctggataaattgctactttgcattcgacaatgactgtcctcttggcggctacaagatgagcggctttggcagagattttggtttggacgctctccacaaatacctacaagtcaaatctgttgtgacccccatttacaagtctccctggctttgagagaaatttaggcaagaagggggatggggggcatttgcatcatctgatggctcaaattatcaaattatgaatgattaagagtgtatttgtttggctgaaagcattttcactcgtgtaatttgctgaaaatgatcaataaatgagaatcatttatggccaaaaaaaaaa

SEQ ID NO: 8 - DNA, 1023 bp, Eucaluptus grandis
aaaatttcggaagatccccaatccgtttcaaattctctcgatcaaggaccccacgtttttcctccaaatccaaaaccctaattctccgcatctcgatccgtcgcagatctctcctcgccgccctcctccccgccctcctccccatggcatctcgcaggcgcatgctgctcaaggtcatcatcctcggcgacagcggggtcgggaagacgtctctcatgaaccagtacgtcaaccgcaagttcagtaaccagtacaaggcgaccattggagctgatttcttgacgaaggaagttcagtttgaagatcgattgttcacattgcagatatgggatactgctgggcaagaaaggttccagagtctgggtgtggctttttaccgaggtgcagactgctgcgtccttgtttatgatgtgaatgtcatgaaatcatttgataatcttaacaactggagggaagagtttctacttcaggccagcccatcagaccctgaaaactttccattcgtcgtgttggggaacaagatagatgttgatggtggtaatagtcgtgtggtttctgaaaagaaagcaaaggcttggtgtgcttctaagggaaacatcccttatttcgagacatctgcaaaagaaggattcaacgtggaggctgcatttgagtgtatagctaaaaatgctttgaagaatgaacctgaagaagaaatataccttcccgacaccattgacgtcactggtggaggacggcagcagagatctactggctgtgaatgttgaagagaattaattggctactctttcctgggaatggaaatacagtggaaccgatttatcgtgattcattgctcaataactattacgtaagagactaatgtaggcgaccagatcaaactctcatcatgtatcattagtagatcaaggaagactgttccttggtcttatcggttccctcttctaatgttagtagtttacaagtataatttgtttggacatgtattcttgggtatgagtttgctttgaagtaaaaaaaaaa

SEQ ID NO: 9 - DNA, 1110 bp, Eucaluptus grandis
tctctctctcttcaaatcaatccacccccaaatcctcctcctcctcctccgcccctcgctttctctctctagatcgatcggccggtcgatttgatcggagcagctgcggcgagtcggagcggggcgatggcggtgccggagaacctgggcagggaccagtacgtgtacctggcgaagctggccgagcaggcggagcggtacgaggagatggtggagttcatgcacaagctggtcgtcggctggacgccggccgccgagctcaccgtcgaggagcggaacctcctctccgtggcctacaagaacgtgatcggctcgctccgggcggcctggcgcatcgtctcctccatcgagcagaaggaggagggccggaagaacgaggaccacgtcgtcctcgtcaaggagtacagatccaaggtcgagaacgagctctccgacgtgtgcgccagcatcctccgcctcctcgacacgaatctggtcccctcggccgccgccagcgagtccaaggtgttctacctgaagatgaagggggattaccaccggtacctggccgagttcaaggtcggcgacgagaggaaggccgccgccgaggataccatgctcgcttacaaggcggctcaggatatcgctcaagcagatctggcttcaacccatccaataaggctgggtctggcactcaacttctctgtgttctattatgagatccttaatcagtctgataaagcttgcagcatggccaaacaggcatttgaggaagcaattgctgagctggatacattgggtgaagaatcatacaaggacagcactctcatcatgcagctgctaagggataatttcaccctctggacttctgatgtgcaggaccaattggatgagccctagaagatgcagcgtaagctcaacggaaattcgaaactttgttctgggaggaggtgggctgtgaaatgtcatttgtcggtaccgatttaaagcgtgcatcagtgacatgtttctcttttatttttagattattaaatccttttcctgtttccaaaacgaattggaaaacgctcttgggtttgtgaacgtgcttctcactgctttagtgttggttttcactggataaaaaaaaaa

SEQ ID NO: 10 - DNA, 1293 bp, Eucaluptus grandis
ctctctctctctctccgccaaacgctctcgaagaaatcaccagggaaaaaaaaaaaagaaaaaaaagagaaagaaaaaagatcaggaaatcgaaaaaaccgaaagaggaagaagagaaccccccaaatccccccctcccccagttccagatctagaagccccggcgagcagcgagcgagcagcaatggcgacggcaccatcggcgcgcgaggagaacgtgtacatggcgaagctggcggagcaggcggagcgctacgaggagatggtggagttcatggagaaggtcgccgccgccgccgccgccgccgacgccgaggagctcaccatcgaggagcgcaacctcctctccgtcgcctacaagaacgtcatcggcgcccgccgcgcctcctggcgcatcatctcctccatcgagcagaaggaggagagccgcggcaacgaggaccacgtcgccgccatccgcgactaccgctccaagatcgagtccgagctctccggcatctgcgccggcatcctcaagctcctcgactcccgcctcatccccgccgccgcctccggcgactccaaggtcttctacctcaagatgaagggcgactaccaccggtacctcgccgagttcaagaccggcgccgagcgcaaggaggccgccgagagcaccctcaccgcctacaaggccgctcaggacattgccaacacggagcttgctccgactcacccaatccggctcggactagccctcaacttttctgttttctactatgagattctgaattctcctgaccgtgcttgcagtttggccaagcaggcttttgatgaagcaattgctgagttggatacacttggagaggagtcttacaaagacagcactttgattatgcaacttcttcgcgacaacctcaccttgtggacttccgacatgcaggaagacggtgcagacgagattaaagaagcaccgaaggctgatgaacagcagtgaggtcttgactattgctcgctgtcaaatttctccattcaatgtttttacttggagaaggtgcttgttgctgatttctcttttattccgaagttggaggcatcatcgtctctttttatttgtttctgactttagtttgtctcatcaatctcctcatgtgctatcaattgtgccttatttttcttggaggcatggagcttcaaattctgcattgagtgtagcagatcccttctattagattattcatatgactatgtgactgatgatatcttctttctttgtcaacaagatatttgattcgatgtgctaaaaaaaaaaaaaaa

SEQ ID NO: 11 - DNA, 1167 bp, Eucaluptus grandis
gctctctctccctccctccctccctctctctctctctctctctctctctctctaaacccgacgcgattttcgaatccgacctccctcgacaaccctctccgatggccgccgccgcaccgccgccgtcctcgccgcgcgaggagtacgtgtacatggcgaagctggccgagcaggcggagcgctacgaggagatggtggagttcatggagaaggtgtcggccgccgccgccgacgccgaggagctcaccgtcgaggagcgcaacctcctgtcggtcgcctacaagaacgtgatcggggcccgccgcgcctcctggcgcatcatctcctccatcgagcagaaggaggagagccgcggcaacgaggaccacgtggccgcgatccgcgactaccgcgccaagatcgaggccgagctctccaagatctgcgacggcatcctcggcctcctcgacacccgcctcatccccgccgcctccgtcggcgactccaaggtcttctacctcaagatgaagggggattaccaccgctacttggccgagttcaaaaccggcaccgagcgcaaggaagccgccgagagcaccctcaccgcctacaaagccgctcaggatattgccaactctgaactggctcctactcacccaattcggcttgggctggctttgaacttctctgttttctactatgagattctcaactcccccgaccgtgcttgtggtctcgctaaacaagcctttgatgaagcaattgctgagttggacactcttggtgaggaatcctacaaggacagcactttgatcatgcagcttctcagagataacctgaccttgtggacatccgacatgcaggatgatggagtggatgagatcaaagaaacagccaaggctgatgagcaatagtgatgtctcagctgctcatcaatatccgtatagaagctaccctcttatctgttttttaactggggaagattgctggctactgattcatgtgcaattctgggttttaggctcgttgtctctataacagaattctggtgttgcttgtcttatcgaagtcttatgtatttccaaatcactcttatttctcttggattcttaatgcttcaatatctcaattgaacacgataaaaggcctccatgtctatgcagattgttgcctactttaaaaaaaaaa

SEQ ID NO: 12 - DNA, 1432 bp, Eucaluptus grandis
ctctctctctctctctaatttccttcacctcaaaccccccccccccccaaatcccaccggctcccggcagcaaccgccgatcgccgatcgccgccgccgccgcgatgaagaaggggggcttaaaccccatcctcaacctcaagctctccctccctcctcccgatgaggactccatcgccaagttcctgacgcagagcggcacgttcgtggatggcgatctgctcgtcaacagggacggggttcgggtcgtgcagcagaccgaagtcgaagtgccaccccttatcaagccaacagacaaccagttgagtttagcggacatagacacaattaaagttattggaaaggggaatggtggaatagtccaattggtccaacacaaatggactgggcagtttttcgcattgaaggtcatccaaatgaaggttgaggagtctgcaagaaagcagatagcacaggaactcaaaattaatcaatcttcgcagtgtccatatgttgtggtctgctaccaatctttctatgataatggtaccgtttctattatattagagtatatggatggagggtcgctggcggattttctgagaaaagttaaaactattccagagccaaatcttgcggtcatttgtaagcaggtgctcaagggtttgttgtatctgcatcatgagaagcacataatacatcgagatctgaagccttctaatctgttgataaatcatagaggagaagtcaagattactgattttggagtgagtgctataatggctagcacatctggacaagctaatacctttgtcggcacatataactatatgtctcctgagagaatcattggaaacaattatggttacaaaagtgatatttggagcctgggcttagtattgctagagtgtgcaactgggaagttcccatatacaccgcctgatcaacaagaaggatggaccaatttctatgagctcatggaagccattgttgatcacccaccgccttcagcagcttctgatcaattctctagcgagttctgctcatttatctctgcctgtgtacagcaggacccaaagaaaagatggtctgcgaatgaacttatgggtcatcctttcatcagcatgtatgaggacttgaatgttgatcttgcttcctacttcactaatgcaggctccccgcttgcaaccttttgaaactccactgtggttccagcaaccggagatctttggctccctgggagcttagagagcagtttcaagaaaaacacctgctcaggattttaatttattatgaaagtggataacttttggagctgataactgtctgcctcgagcggagtgtagtggagtggagtgaagtgttggcagttaaagacgatttcaagggcgtgattactttgagcgtcgaaggacagctgatgtaaattcgaaatttctttcttattgcaagg

SEQ ID NO: 13 - DNA, 833 bp, Eucaluptus grandis
ccggcattgccccgacccgacccggcacggatggaggacgacgagcggggggaggagtacctcttcaagatcgtgctgatcggcgactccgccgtcgggaagtccaacctcctctcccggttcgcgctcgacgagttcgacatcaacaccaaggccaccatcggggtcgagttccagacccaggtcgtggagatcgacggcaaggaggtgaaggcccagatctgggacaccgccggccaggagcgcttccgcgccgtcacctccgcctactaccgcggcgccgtcggcgccctcatcgtctacgacatcacccgccgcaccaccttcgagagcgtcaagcggtggctcgacgagctcgatactcactgtgataccgctgtcgcaagaatgcttgttgggaacaagtgtgatttaaacaatatcagagaggtgagcaccgaggagggcaaagcccttgcagaagcagaagggctattctttatggagacctccgccctcgattccacgaatgttcagatatcgttcgagattgttatccgcgagatatacaagaatatcagcaggaaggtcctcaactccgattcatacaaggcggaattgtccgtaaatcgagtgaccctcgccaaaaacggtgcggactcgtcaggtcggagtttctactcgtgctgcgctagatgatgtccgatccttcatgtacgctccatcaattttttggagtctcttgtactgttttatttcatcaaatttttggaagtgtcttgcactgtcttattttatcaatttgtatcctaatacgtggccaatgaactttacggttttcttcaaaaaaaaaa

SEQ ID NO: 14 - DNA, 1040 bp, Eucaluptus grandis
cgagcacagtcggtggtcagaccactttcccacgtctttttctctttcctcctcctcctcttctccttcaatcccctccgcattccaagcgtccgctgcattggatcgacctctgacggaacctgcagaagaagcgagagacagaagagcgagaaagcagagggagatgtcgtcgtcggacgaggagggaggggaggagtacctgttcaagatcgtcatcatcggggactcggcggtggggaagtcgaacctgctgtcccggtacgcccggaacgagttcaacccccactccaaggccaccatcggggtggagttccagacccagtccatggacatcgacggcaaggaggtcaaggcccagatttgggacaccgccggccaggaacgcttccgcgccgtcacctccgcctactaccgcggtgccgtcggcgccctcgtcgtctacgacatcacccgccgctccaccttcgacagcgtctcccgctggctcgacgagctcaagactcactcagacacaacagttgcaaggatgcttgttgggaacaaatgtgacctggagagtattagggatgtgacggttgaggaggggaagagtttagcggaatcagaagggttgttctttatggagacttccgctttggatgccacaaatgtgaagacagccttcgagatcgtgataaaagaaatatataacaatgtgagcaggaaggttctaaattcagatgcttataaagcagagctctctgttaacagggtaaccttggctggtaatggggccgatggatcaaagcggagtcagagcttttcttgctgttccaggtgatactgtagaggtgtaattctttcaagtccgatgatgaaaacttcattgtcgattctattggttgagctgtctgtttgtttggtttttgcttgttttttcttatcaggggtttttaaaatgctgttatagcaaattttattcaagaatattaacctatcgatttcttctagttctagatatatgtaatagcaaagaattatgtggaccaaaaaaaaaa

SEQ ID NO: 15 - DNA, 1573 bp, Eucaluptus grandis
gaaagatcgagaaacctgctgcggctgctaagtgggaggactagcagagacaaaccaatttccacacgtctctctctctctctgctctcagaccagacggcgacaaaactgagctccggctcggagcgacagcaaaacccaagccacacagaaagagagagatacacagaatagcaatggcgctggttccatccgatcccatcaacaacggccagtccctccccctcatcgccgaggtcaacatgtcctccgactcctcctccgccgccgccgtcgtccgcgccaccgtcgtccaggcctccaccgtcttctacgacacgcccgccactctggataaggcggagaggctgctggccgaggcggcttcgtacgggtctcagctggtcgtcttccccgaagccttcgtcggcggttacccccgcggctccaccttcggcgtcagcatcggcaatcgtacggcgaaaggcaaggaggagttccgcaagtatcacgcctccgccatcgatgttccaggccctgaagttgatcgcttagcagcgatggctggaaaatataaagttttcctagtgatgggggtgatagagagagatggatatacattgtattgcacaatcctgttttttgatcctcaaggtcattaccttgggaagcaccgtaaagtcatgccaacggctctggagcgtgtcatctggggatttggtgatgggtcgaccattccggtgtttgatacgccgattgggaaaattggtgcggccatttgctgggaaaatagaatgccacttctgaggacagcaatgtatgctaaaggtgttgaaatatattgtgcgccgacagctgatgcgagggacatttggcaagcatctatgacacatattgctcttgagggtggatgttttgttttatcagccaaccaattttgtcgtcggaaagactacccgcctccaccagagtatgtttttgcaggaacagatgacgatcttaacccagattctgtcgtatgtgctggaggcagtgtaattatatctccatcaggaaatgttttggccggacccaattatgatggcgaggcactcatctcagctgaccttgaccttggagaaatagcgcgggccaagtttgattttgatgtggttgggcattattcgaggcctgaggtgcttagcctgatcgtgagggaccatccgagcaacccagttacctttgcatcgacatccgggaagcctgaaggcccttacaaataggttatgttttctttcacggagccaggtctgaatcatggcaaataacggcaagcaaatgttggtcccagtgggaagcttttgattgtttgtttcaactttttggactcctgattgtttgttcaactttttcgacttcatgagctattgtaaattctgattgcaagcaacatagttcatgaatacttcctgcttgatagttgagaaagcgatgttatatttcagttgcacagtaaacatgtctgtatcctgtgcagtaggactcttgtaactagtctgtatcttggcaatgaaataagaacattagtgactgttctcgtgaattaaaaaaaaaa

SEQ ID NO: 16 - DNA, 2613 bp, Eucaluptus grandis
tctctctctacacactctctctctctacattctttctctctcttcactttctctctctactgtgtccctgcccaaattgccatttctgaagtgtgtcagcttcgccctttgggtggagttaaacagagatcacaataatctccttcattattgtcatcttgacatcgactcctctctccctctctctctctctccatccatctcctcctcgttctctctctatattacccatttcgcctccgtccttccgtttctctctcctcctctccttccccccccttttccccccaacctccagttcattcggcatcactcactcccaatctcaatctcccggacccatgtatcaaatctgaatctttgctctcaattcccaatccccggtcgaatctttgactacccatcttcgaatcctcttctgggtcgccctctatctccctccccacgtcccccgcctccgccgccggagcggccggggttctgcagccgaggccgccgcgaccggccgcattgagcccggagccgaccgccgtccgccgtccgggaccgatccggagcgcaaagtcatgagcttggcggggtcttggtgattccccgggaggtgggtcggtcatggatccgagcaaatcgcgcgactcggcggagtcgacccgggtgatacagttcccgaacgacgtgctggagcggattctgtccctcatagactcgcaccgggaccggaacgccgtctccctcgtctccaaggcgtggtacaacgcggagcggtggacgcggcggcacgtcttcatcggcaactgctacgcggtgtcgccgcagatcgtggcccgccggttccccaacatccgcagcgtcatgctcaaggggaagccccggttctcggacttcaacctggtgccgcccaactggggtgctgacgtacacgggtggctcgcggtcttcgcggatcagtacccgcagctcgaggagctgaggctcaagcggatgaccgtgacggacgagagcttgaagttcttggctcgcaagttccataatttcagggtgctctcgctcctgagctgcgatgggttcagcaccgatggtctcgaggcaatcgcaaccgactgcagacatttgactgagctggatatacaagagaatgggattgatgatatcagtggcaactggttgagttgcttccctgaaaacttcacatctatggaggtgctgaactttgcaagtctaagtagtgatgtgaattttgacgctcttgagaggcttgtaagtcagtgcaagtcactgaagattttgaaggttaataaaagtattacgctagaacaattacagaggctgcttgtccgtgctcctcagttgaccgagcttggtactggttcgtttttacaagagcttactgctcaccagtctgaggagcttgaaagagctttcattggttgcaagtatctgcatgcactctccggcttgtgggaagctacgacactatatctacctgttctttacccagcctgtacaaatttgacttttctgaatttaagttatgctgctttgcaaagtgaagagcttgccaagcttgttgcccactgtccacgtcttcagcgtctctgggtacttgacactgttgaagatgtaggacttgaggctgttgcctcgagttgtccccttttagaggagcttcgagtcttcccagctgatccttatgaccaggacattaatcgtggtgtgactgaatcggggtttcttgctgtgtcgctcggctgccgcaagctccactatgtcctctacttttgccgtcagatgacaaatgctgctgtagccagaattgtgcagaactgccctggttttacccactttcgtctttgcataatgaagccggggcaacctgattacctaacaaatgaacctatggatgagggttttggtgcagttgtgaagacttgcacaaatctccgaaggcttggcgtttctggtcttttgactgacttaacgttcgagtatattggaagatatgcgaagaacttggaaacgctttctgtggcttttgctggcggcagcgatctcgggatgaagagtatactggttggttgcccaaagttgaggaaacttgaaataagggattgtccatttggtaatgaagctcttctttcgggcttggagaaatatgagtcaatgagatctttgtggatgtctgcttgcaaagtgacgctacatggttgtaagacattggctacgcaaaggccacggttgaatgttgaggtaatgaaggatgaggagatcgatgatggccagtcttataaggtttatgtttaccgtactgttgctggaccaaggacagatgctccatcttttgtccatactctttgaagttgataattagagggagctggtgccaggattctggaactttcaagggcagcctgtgttctgcgaagtcagcccttgtgctaatgctggagcccggggagcggaacagaactcatgttcctgttacctcaactgttttacaaggcctccacctgtggtgctcaatttgttgtagcaaggcaccttgaaatttaacttcttgtagactcgtgaaatttccttcctttgtcatattttcttctgagtgttttttaactc

SEQ ID NO: 17 - DNA, 2817 bp, Eucaluptus grandis
ggagagatagagagagcgagaggagagagacggcgatggaggatgaggaagaagagacgacgacgacgacgatgatgcgcggaccatgccgatccagagacggcggcgcagcagcggcggcggcggcggaggcggcggggccttccaccgtgtgttgacttctctctcccggccctcccgactccgccttcgggctcggcggacttgattagtcgggcatgtgaaaaagaatctttgactgctcagattgttgaacaacgtgatggagtcctgcaactgcgttgagccacagtggccagctgatgagcttttgatgaagtatcagtacctctcagatttctttattgctctggcgtacttttccatccctctagaactcatctactttgtcaagaaatctgctgtatttccctatagatgggttcttgttcagtttggtgccttcatagttctgtgcggagcaacccacctgatcaacttatggacatttgccatacactcaagaactgtagcatatgttatgaccattgcaaaggttttaactgctgcggtatcatgtattacagctctcatgcttgtgcatatcatccccgatctacttagtgtgaaaaccagggaactatttctgaaaaacaaggctgcagaacttgacagggaaatgggcttaattcgtactcaggaggaaactggcagacatgtcaggatgctaacgcacgaaatcagaagcactcttgatcgacatactattttgaaaactactctgattgaactgggcagaactttgggattggaagagtgtgccctgtggatgccaacacgaagtggcttggagcttcagctatcctacactctccgtcagcagcagaatccagttggatacacagtacccattcatcttcctgtaatcaatcgagtgtttagtagcaatcgtgcgttgaagatatcacccaattcacccgttgctagaatacgtcctcttgcggggaaatacattcccggtgaggttgtcgctgtgcgggttcctctgctgcatctctctaatttccagataaatgactggcctgagctttcaacgaaacggtatgctttaatggtgttgatgcttccatccgacagtgctaggcagtggcatgtccatgaactggagctcgttgaagtggtagctgatcaggttgcagttgctctctcccatgctgcaatactagaagagtctatgcgggcaagggatcttctcatggagcaaaatgttgcacttgatctggccagaagagaagcggaaacagctattcgtgctcgcaatgattttttggctgttatgaaccatgaaatgagaactcccatgcatgcaattattgccctttcttccttactgcaggaaactgaactgacccctgagcagcgtctaatggttgaaacgataatgaagagcagtaatcttttggctactttgataaatgatgtactagatctttcgaggcttgaagatggaagctttcaacttaacatcgccacgtttaatcttcatgctgtgtttagagaggtccttaatttgattaaaccggtggcatctgtgaagaaactgctcatcacattgaatttagccccagatttgcctgagtatgctgttggggatgaaaaacgcctcatgcaagtcattttaaatgttgttggtaatgcagttaaattttctaaagaaggtggcatttcgataaccgcctttgtggctaaagcagagtatttaagagaagccagaactcccgaatttcttccattgccaagtgataatcacttctatttacgtgtacaggtgagagattctggatcaggtgttaaccctcaagatattcccaagttattcacaaaatttgcacataaccaatcattagcaaccagaaattctggtgggagtggactaggtcttgcaatttgtaaaaggtttgtaactctcatggatggacacatatggattgaaagcgaaggcattggcaaaggatgtactgccacgtttattgtaaggctgggaatcccagagaagttgaatgaatctaagttccctgtattacccagagggtcatcaaatcatgtcctggccaatttttctgggctcaaagtgcttgttatggatgataatggtgttggcagggcagcgaccaagggacttctcctacatctgggatgtgatgtgacaaccgtaagctcgggggatgagttgttgcatgctgtctctcaggaacacaaggtagttcttatggatatttgcacgcctggtatagacagttacgaagttgccgtccagatacacaggttgtattcacaacatcatgagaggccactcttagtggcaatcactggaagcactgacaaggtaaccaaagagaattgcatgagggttgggatggatggtgttatccagaaacctgtgtcgcttgataaaatgagaaacgtactgtctgagctactggaatgtggacatcaaatgtctagtttggcccgtgtttgagaagaatggagaaaataagactgcgataaagtttcttgcggcaaatgatttgtaaatactgcatgcagtggaacattggagggttatcaagcaatgctacaacaaccccatgtaatacgagactcataccgatcatttttatccaagaatgaccaaggtcatcagatgattgaacaagccgaagccccatagtggagctgctagtaacttcacgggatgatgacaagtcttatgtgtcgtcgacaaagttgtgatgtcgttgcaattgtaagatattatggtcccatcaatgatatctctttgtttgaaaaaaaaaa

SEQ ID NO: 18 - DNA, 1064 bp, Eucaluptus grandis
gaaaagcttctgtacatgcgcaatcccaaaggaagccctctgaacatccgttgatccctggcggaaaaaagaggcagcacccattgatcaccagggagaaagagagagagggttgcttacggattctccgaattcgcaagaatggcttctcggagacgcatgcttctcaaggtcataatccttggtgacagcggggttggaaagacatctttgatgaatcaatatgtgaaccgaaagttcagtaatcagtacaaagcaaccatcggggcagatttccttaccaaggaagtccagtttggggatagacttttcacattgcagatatgggatacagcggggcaggaacggttccaaagtctcggtgttgccttttaccgtggagctgactgttgtgttcttgtatatgatgtgaatgtgatgaaatcgtttgacaaccttaaccactggagagaggagtttctcattcaggccagcccttctgaccctgagaacttcccatttgttgtgttgggaaacaagattgacattgatggtggcaacagtcgagtggtatctgagaagaaagcgaaagcatggtgtgcctcaaagggaaacatttcttacttcgaaacttctgcaaaggaaggttttaatgttgaagcagctttccaatgtatagccaagaatgcccttaagaatgagcctgaagaagaactctaccttcccgatactattgatgtggctggtggacagcagcagcgttcttcgggctgtgaatgttgaagagtatatgactttaaatttgctggtccctcgagaaaagactcgcaaaagacggccatcattttacttctgccgactgtgaatcgccagggcactaccggttgttgagagtgccatgtatatcattagcaatgttcatcagttcagcacaatatttgtggtttcatcgttccaaaatcgtgcgttgtgaaattggttgtgtataatctctagaatccaaaggcttacgggtcatgcaatcctttctaatttgattactcagatgtccaagctgtacacttaatttgctctcaaaaaaaaaa

SEQ ID NO: 19 - DNA, 1118 bp, Eucaluptus grandis
ggtcgaagctgaaaatctgacaaaatcctctccccgcggccgtttccgttcttgagcttcgatccgcagggaaggggagctccgagcaatggcgggcggctacagggcggacgacgactacgactacttgttcaaggtggtgctgatcggcgactccggcgtcggcaaatccaacctcctgtccagattcacgcggaacgagttcagcctggagtccaagtccaccatcggggtcgagttcgccaccaggagcatccgcgtcgacgacaaggtcgtcaaggcccagatttgggacaccgccggccaagagagatatcgtgcaatcacaagtgcctattacagaggagcagttggtgcattgcttgtttatgacgttacgagacatgtcacttttgagaatgtcgaaagatggttgaaggagctgcgggaccacacagactctaatatcgtgataatgctggtaggaaacaaagcagatctgaggcacttgcgtgccgtgtctacggaggatgccaaggcctttgcagaaagagagaacacttacttcatggagacttccgctcttgaatctatgaatgtagagaattcattcaccgaagtgctcacacaaatataccacgtggtgagtcgaaaagcacttgatgttggggaagatccggcagcacctcccaagggacaaactatcagtgtcggttcaaaggatgatgtttccgcagtcaagaaagtgggctgttgctccgcttgaagttaagagtaacagaatgaagattttgggggaagtctttattcaatcctaatctgctgcccggagaattggaagatgttacgcgggaattgcagaccttctttacaacctgtcaccatcatctccatgcatggcgatgcttaagcttttgccggatcaatttaagtttgaagtccaaggaaaccggatgttagggcttcgtgtatttcatttgtttcatttccagatgcttaattttctattcccatcccgtgttgatttgtttgttgggttctctaggtttttgagctgaattggtcatgtcacacagggaactgtcttcgggcgagtttaatcatgtatctgatttacgatcggtgttgtgaacgtcgga

SEQ ID NO: 20 - DNA, 914 bp, Eucaluptus grandis
caccaaccatcccgggcgggcggcctcgactccttcttgttccgtgcagttttcatagactacttccattaacgagaatccttcctccatcggcgtctccttctccttgtgcttcttgttcttggtgagactcttggaaaagggatggtggattcgttcgacgaagagtgcgattacttgttcaaggccgtcttgaccggggactctgccgtcgggaaatcgaatctcctatcgaggttcgcgaggaaggagttccagttggattcgaaacccacgataggcgtcgaattcgcatacaggaacgtcaaggtcgccgacaagctcatcaaagcccaaatatgggacactgcagggcaagaaagatttcgagccatcaccagttcatactatcgcggagcactgggggcgctgctggtttacgacatcactcggcgagtgacgttcgagaacgtgaagaaatggctgcgcgagctcagagactttgggaatcccgacatggtggtggtcctggtcgggaataagtccgatctgggcagctctagagaagtggacctggaagaagggaaggactttgcggaggcagagaatctgtgcttcatggaaacttctgctctggagaatctaaatgtcgaggaagcattcttggagatgatcaccagaatccatgagatcacaagccagaagagcttagaagccaagaacaatgaaataaccagtagccttcacggtcctaagcaggtcattcagattgatgaggtcactgctactaaaaagccatactgttgctcaagttaatcccaaccgttgggggattttttgacgagtcagtaccaaatttatagttgcctactgaccacatcttgatttttttcccctgaattcaagtccaatcagcttcctctttaaaaaaaaaa

SEQ ID NO: 21 - DNA, 911 bp, Eucaluptus grandis
ggtaattgcccaaatcagattcctagattctagccaactcgacaaccgtctccaccctttctttcttcccctcaaatttcaaatcagtccaaaaaaactcaagactgctgctgctgccgattgattcgccatctccttcccaccttccctccttcctctccaatctctcgaagctccgttgctttcatggccgggtacaaagccgacgaggagtacgactacctgttcaagctggtcctgatcggcgactccggcgtcggcaagtccaaccttctctcccgcttcacccggaacgagttcaacctcgagtccaagtccaccatcggcgtcgagttcgccaccaagagcttgagcatcgacggcaaggtcgtcaaggcccagatttgggacaccgccggccaagaaaggtaccgtgccatcactagtgcttactatagaggagctgttggcgctttacttgtgtatgacgtcaccaggcgtgcgacttttgagaacgttgcaaggtggctgagggagttgagggaccacaccgaccccaacatcgtggtcatgctcattggcaacaagtctgatcttcgccaccttgtggcagtcccactggaggatgggaagtcatttgccgagatgagtcactactatttcatgcagacttctgcattggacgcgaccaatgtggaagcagcttttgctgaagtccttagtcagatttatcggattgtgagcaagagagcagtcgaagcgggtgacaacccaagtgtttcttctgttccaggtcagggacaaacgatcaatgtcaaagaagaggggtctgtttttaagaggattggatgctgctctagttaaggtaggtttcttcggctgcttgttgctccaagggtgggtctgccaagtgctacctctgtgtatatttt

SEQ ID NO: 22 - DNA, 1157 bp, Eucaluptus grandis
ggtcattgaagtctaatcatcttcaacctctcaccgaacagacgctgctgctgctctctccttctttccccttccccatcaacacgctcgtctctgtccctgtccctgtccctgtttctctctctaccctccgagatctccacagtagagagagaaagacagagagagagagagagagagaagtgacgtggtgacagtagagagagaaaagacccgagcttgagtcgtgggtcggtcgtgggcaatggcgagcggaggaggctacggggacgggaaccagaagatcgactacgtcttcaaggtggtcctgatcggggactccgccgtcgggaagtcccagatactctcccgcttcgcccgcaacgagttcagcctcgactccaaggccaccatcggcgtcgagttccagacccggaccctcgtcatccagcacaagagcgtcaaggcccagatctgggacaccgccggccaagaacgatacagagctgttacgagtgcatattataggggtgcggtgggggcaatgcttgtttatgacattaccagacggcagagcttcgatcacatacctcgctggttggaagagctgcgtagccatgctgacaagaacattgtcattattctggtcggtaacaaaaccgatctcgagaaccagcgtgccgtgcccactgaggacgcgaaagagtttgcccagaaggaagggctcttcttcttggagacctctgcattggattctaccaatgtcgagagtgcattcttgactgtcttgaccgagatattcaacatcgtcaacaagaagagcctagttgctggagagagccaaactaatggcaatcctgcatctttggctggcaaaaagatcatcatcccgggtcctgcccaagaaatcccagccaagaacaaaatgtgttgcggaacataatgcacttcgacgtgattttcctcttatgctctagcaatttttcctcagatttgtcatgtgtgctgctttatattctatgtatatctacatattagaagagtggtggggttatactgctgattgtaatagtgtgtttcgtgaggtcacagacacaatagacctaactggggtgcatattcattgaatgatttttggcttcggaagttatatttcatgcaatttgccaaaaaaaaaa

SEQ ID NO: 23 - DNA, 1704 bp, Eucaluptus grandis
gtacgtttctagagagagaaagtgaagagagaggatagaagagaagagagagagagagagagagagagcgctgaggaggttagaggtcatggctgacgccgcagctcagaacggccagttcagcgacttcccggcggtcccgacccacggcggccagttcatccagtacaacatcttcggcaaccacttcgagatcacggccaagtaccggccgccgatcatgccgatcggccgcggcgcgtacggcatcgtctgctctgttctgaactcggagacgaacgagatggtggcgatcaagaagatagcgaacgcgttcgacaaccacatggacgccaagcggacgctccgcgagatcaagctgctccgccatctggaccacgagaacgttattggcattagagatgtgattcctcctcccctacggcgagaatttactgatgtctacattgctatggaactcatggacactgatcttcaccaaattattcgttcaaaccaaggcttgtcagaagagcactgtcagtacttcttgtatcagattctacgtggactgaagtatatccactctgcgaatgttattcatagagacttgaaacccagcaatcttttgctgaatgccaattgtgacctgaagatcattgactttggcctggcacggccaactgcagaaaatgaatttatgactgaatatgtggtcaccagatggtacagggcaccagaattgctgttgaactcttcagattatactgctgctatagatgtgtggtctgttggttgcatatttatggagcttatgaacagaaagcctttgttccctgggagggatcatgtgcatcagatgcgtttgcttgtagagcttcttggtacaccagctgatgccgatcttgggtttgtgcgaaatgaggatgcacgccgatacataagacagcttcctcagcatccccgtcaaccattggctagtgtttttcctcatgttcaccctttggccatcgatctggttgagaagatgttgacatttgacccaacaaagagaatcacagttgaagaagcactcgcccatccttatcttacgagattacacgacatagctgatgaacctgtgtgccgacaaccattttcttttgagtttgagcaacagcccttgggagaagagcagatgaaggacatgatatatcaggaggctatagcgctcaatccagagtttgcttgatgctgtttaaagtttctatggtggatgaggaactgcgaactaaagtggaaacagtgcagcgcaacgaaatgaagagttgcacatattcagaggcaaccgatctcgttgctttatttttccgtggagtaagtatgccgtaccacgaatactgatttgaggggagctttgctccacctgtcgaataaactttcttgattccttgaaacgccttttgtttttgcaatcggtgcttcttggcattcttttattagcttgtatttcactcaacgtgcttaatatcattttgttgtaacatttcacagtttgtaaatttgtactgcaagatgtattagtaagaagaactgtatttttttttatttttttggttcattgaaccgtgcttcagtttatgaatgctaatctgtatgtaacgcgcagagcagggcgctagagcttttatctgtgccttcacaacttctgttttattataaatcccttcgttcccaaaaaaaaaa

SEQ ID NO: 24 - DNA, 1894 bp, Eucaluptus grandis
ttctcgataagcaataattgctgcccttctcttttcctcgtcactgctacagaggccgggtctaatcgcgacgaggtgacgaatctgagatcgaaagtcgtctcctcttgttgcggggtcagatccgtagggctcgtggcttgacaagaacagtgctttccgagggaataagcagatcccaatgcgttaggggaatgattgcgtagggctgcgatcttgggcatctgttgctgtcgggaattcttgcgaggagaagggcctctgaggctgcgtcgtgctggggagttgatgaattgcgcctgctcgggggaagagtgagtgggatccgacgatgggtctgagcaagaatggcttctttctttgaattcgcttcgaagatcacataaaaagcaaatggcaacactagttgagccgccaaatggggttcattccgagggaaagcactattactcgatgtggcagaccttgtttgagattgacacaaagtatgtgcccatcaagcccattggccggggagcctatggcattgtttgctcttctgtgaacagagaaaccaatgagaaggtggctataaagaaaattcacaatgccttcgagaatcgggttgatgcgctgagaactttgcgcgagataaagcttctcaggcatcttcggcatgagaacgtcattggtctgaaagacgtcatgatgcctatccagaggaaaagtttcaaagatgtctatctggtgtatgagcttatggacacagatctgcaccagataatcaaatcctctcagacacttacgaatgaccactgccaatatttcctcttccagttgctacgaggcttgaagtatctacattcagcaaacattctccaccgagacttgaagccagggaaccttctcatcaatgcaaactgtgacctcaagatctgcgattttgggttggcacgagctagcaatggaaagggacagttcatgactgagtatgtggtcactcgctggtaccgggccccagaactccttctgtgctgtgacaactacggcacatccatcgatgtgtggtctgttggatgcatcttcgctgagcttctcggacgtaagccattattccctggtactgagtgcctcaaccaactcaaactgatcatcaatgtcctcggcagccaaagagaggaggatatcgaatttatcgacaacccaaaggcgaaaaagttcataaagtctgtcccatattccccagggactccattatcccgtctttaccctaatgcacatcctctggctattgatctcctgcaaaagatgctcattttcgacccatcaaagcgcattggcgtcactgaggctctccaacacccatacatgtcaccgctgtatgatccgaataccaatcctcctgcgcaggttcccatcgacttagatgtcaatgaagatctggaggaagagatgataagggagatgatgtggaaggaaatgctccattaccatcccgaagtcgctgtgggcaatttagaggtgtactcttaagcattcttcagttgttttgtctcgcctctctgtgataaggtactccatcaatatgctgctgcacttcattatgatggttctgtagtttctcttaacatataggctagcttttcctctttttctcagagaggggataaaataatttgctggaatcatgcccaggaagttcttgtcctcaaaatgcatgattgagcaaccgttatctttcttcttcactatgtctgtttgagatccatgtactaggtttcctatctaacctgtaaatagccttattgctatgagacttcaggcttgttgtacaattatatgatatgcttgaggatgcttttataacatctggtttggacgtaataagagtacttctaaagctgtaaaaaaaaaa

SEQ ID NO: 25 - DNA, 2832 bp, Eucaluptus grandis
gctctctcttcgttcgcttcactgcccccctctctctctctttctctctctctcctcgagctgagctcaactcgaacaagagcattgcggttcacacagaggagggcagaggagagagaaagatagagagagagagagagagaggaggaggaggagagagagagctctgcatattcagggtcattgaggagatttgtatctacttatggagattgtagattctgcgatctgagaaattcgggagctctgcttatctttttctcttcctgtcttgtcttttttgtttgttttttcgtttttttgggtctccctcttctcagctgctgctgcttgctgcagctgctgcagcaatcatcatcatgacttcttgattcgtagatgataggtgaagaagaagaagaagaaagggggggtttttctctttctctgctctctttcctagctctctgctccttacccagaaagccgttcgttctctctctcgggccggaatttgctcagcgtctgtcttttcctctctccgttcagatctaatcggaatcgggaagatatgtaagggggggtcttctgggttttgtccgtcgccatttcctctcgagcctcgcgcggttttaagcgtttagatctgggtttttcttagctgggtaggtttggattcagttcgcaggttgtagtagcttaatctctgtacatttgttttttttttttttttttttttgtctccgagctatttggttcttttggggcgaagggttgtgttgggattaggttgtttttgccgccccccggctgtttttttcgttagggtttctgttcttttttcttctttcttcctgcgggagggatggattgagggctcatttcgtttgaaagttgggattttttttttcctgggcagtcgtgggaattggatttgtcacttgggtaagggaagatgaattattttcccgatgaagttatcgatcacgtgttcgactttgtgacgtcgaacagggaccgcaacgtgatctctttagtgtgtaaatcttggtataggatcgagaggcttagcaggcagagagtgtttatcgggaactgctacgcgataagtcctgagagattgatcgcgagattcccgggggtaaggtcgctcactttgaaggggaagccccatttcgctgacttcaatctagtgccacctgactggggagggttcgtgtacccttggatcgatgcattggctaggagtaaggttaatttggaggagctcaggttgaagaggatggtggttacagatgatggtcttgagctgatttcgagatcgtttgtaaatttcaagtccttggttcttgttagctgcgaagggttcactactgatggccttgcggctatagcagccaactgtaggtttcttagggagctggacttgcaagaaaatgaagttgaggatcatagaggccagtggctaaactgctttcccgatagctgcacctctcttgtctccctaaattttgcatgcttaaaaggagatataaatttagcagcacttgagaggcttgtggcaagatctccatatctcaagagcttgaggctaagccgtgctgtccctcttgacacgctgcagaagatcctggtccgagcacctcagttggtggacttaggcgtgggctcttttgtccatgacccagattctgaaacctacaacaagttggtgacagcaattgaaaaatgcaaatctatgaggagcttatccggattcttggaggtttctgcgtactgcctaccagctatttatccaatatgttcaggcctgacctccttgaatcttagttatgctcctgggatccctggaagtgagctaactaagttaatccgtcattgcagaaagctgcagcgcttatggatacttgactgcataggagataaagggctgggagtcgtggcttcaagctgcaaagaactacaggaattgagggtttttccgtctgatccttacggagttggaaatgctgcagtgaccgaagaagggttggttgctatttccagaggttgtccaaagcttaactcactgctgtacttctgccagcagatgacaaatgctgccctgaaaattgtagcccagaactgccctaatttcatacggttcaggttgtgcatcctcgagcccacaaaaccggattcttcaaccaatcagcctcttgacgaaggattcggagctattgttcagtcatgcaagggtgtcaggcgcttgtcactttctggccttcttactgaccaggtcttcaattatattggcacattcgctgaacagcttgagatgctttctattgcatttgctggggacaacgacaagggaatgctttatgtgttaaatgggtgcaagaagattcggaaattggaaatcagggattgcccctttggtaacatcgcacttctgacggacgtgggaaagtatgaaacaatgcgatccctttggatgtcgtcgtgcgatattacccttggaggctgcaaaaccctggcaaagaagatgccgaggctgaacgtggagattatcaatgaaaacaatgagatggaggattgcattgatgatgagcagaaagtagaaaggatgtacctctacagaaccttggtggggccgaggaaggatgcaccagagcatgtttggacattgtagggttcccctgaggttcattgccatggctttgcctcaaaatctcctgttgtaccatcattgtacctcgtttaggctcgtaatttgtggatttttagttgtatggtgattttttattttattcagaagagattctaatgtgcttctagttataaatagatttttctttagcaaaaaaaaaa

SEQ ID NO: 26 - DNA, 3174 bp, Eucaluptus grandis
gctcccttgttccttatctcttccatttcctcagcctctgctgttcctccactggacctcccaccacccccctccctcctccctcctcccccctaaccccccaagaaaatcaagaaaatcaagaaaagagacgctgccagcaaaagcagcagcatgctagtcataaaacctcctccactccctgctgccatgaacgaaatttgatcctcagctccccactcacagccctccgaaatctctgaaatcaaagcaaggaaagagagagagaagagagagaagagagaggggaaagagagatgaagagggatcatcgagacgcttgcagtggcggctatggcggcggcggtggcggggaggcgagcggcgcctcgaagggcgagcccccgtcgtcctcctccacccactcattgcccggctctggcaaggccaagatggtgatgtggggcgaggacgaccaagatccgagcggcggtggcgggggcggcatggacgagctcctcgcggtgctcgggtacaaggtgaggtcgtcggacatggccgaggtggcgcagaagctggagcagctcgagatggtgatgggctctgctcaggaggacggcatctcgcacctgtcctacgacgccgtccactacaacccttccgatctctcctcgtgggtccagagcatgctcttcgagctcaacccccctccgccgccgcagcaggtggccgacgcggtcctcgctgcggccgagtcgtcttccaccatcgcgcagcaccaccgttcgcatctcgggtctcggtctcagacgcagactcggactctgagtcagacttcggctcccactcagacgcagtcccaggtaatcttcaacgacgactccgagtacgacttgagggcgattcccggcgtcgccgctttcccacagggcgactcggacttcgagagcgccgcccggaagaagatgaagaccctgaacggcgggtcgaattcgttgtcgtcctcgtcctcttcgtcggccgccggagcggcgccctccgagtcgacccggccggtcgtcctggtggacacgcaggagactggggtgcggctcgtccacacgctcatggcctgcgccgaggcggtccagcaggagaacctgaagctggccgatgcgctcgtcaagcacattggcctgctcgccgcttcgcagaacggcgcgatgcgcaaggtagcgacctacttcgccgaggcgctcgcccgccggatttaccgaatctaccccaacgacggcagcctcgactcctcgtgcaacgacatcctccagatgcacttctacgagacctgcccgtacctcaaattcgcccacttcactgccaatcaggcgattcttgaagccttcgccaccgccagccgcgtccacgtcatcgatttcggcctcaagcagggtatgcagtggccggccctcatgcaggctctggccctgaggcccggcggtccgcccgccttccggctcaccgggattggcccgccgcagccgaacaacaccgacgccttgcagcaggtcggctggaagctggctcaattggccgacactatcggggtcgagttcgaattccggggtttcgtggcgaattcgctggctgatctcgagcccgccatgctggacatccgccctcccgaggtcgagacggtggccgtcaactcggtgtttgagctccaccccctgctcgcccgaccgggggcgattgacaaggttctctcatcgatcaaggccatgagacctaagatagtgacgatggtggaacaggaggcgaatcacaatggcccggggttcgtggaccggttcacggaagctttgcattactactccagcctgttcgattcgctggaagggtctggggtggctcccccgaaccaggatctggtcatgtccgaggtctacttgggtcggcagatttgcaatgttgtggcctgcgaggggccggatcgagtggagcggcacgagacgttggtgcagtggcaggcgcggatgggatcggctgggttcgacccggtccatctcgggtccaacgcgttcaagcaggcgagcatgctgctggccctgttcgcaggtggagaaggttaccgggtcgaggaaaacgatggttgtctcatgctcggttggcacacgaggcctctgatcgccacttcggcgtggcaactcgctgctgcaactcagtgaatcaactgtcgttcggttgagtttggtcgaaatcgagatagaccctgttgtcggttggaccccttagatgatcagtgaatggaagtgctttgcctgagttgggaaggtactaagagaagagaggctacgaaacaacctcagagcgtgtagttccacttcttgttttttgcctctgtgtagtcttctgcaagatcttccaaatcttccttattgatttatttcatgaattttgattttggttagacctttgggctctactcaaggttggatgaatgcgaatgtgtatcctctgcatttagcttctggaataaaatgatgacgacgacgattctcgctgccaaaaaaaaacggatgcaatcgtttacgattcatcacatctctatggaactccaagttactgggtgcaacagtttttcgccgagtcaagtggagcaactcttcttgatacaacaattccagcgaattactccagctcacttctcgcctcagcaatcacgtggacaaattcagatgatgataaaagttatataaagattaagatcgtgaacttcggtagcagtccagttaatctaacaatttccattagcggactggatcaaaattcgatacaaaagtctggatcctcaaagacggtattgacatctgctaacttgaaggatgagaactccttttctgagccgaacaaggtggtgccaacccaaagtctactcgaaaatgcaggcaaagagatggatgttgttatcttgccctattccttcacttcctttgatctgttaaaagaatcgactagcatccggatgaagggagatgattattcgtctaaatcttctatctaatttatatatctgattgagtgtaattatatggaataatctcatgactcagatgttatgatactcaaaagttatgtagatctttgtggctgtaacatgtacttcttgcttacctgttcgatgctatataatataaattatattacataaaaaaaaaa

SEQ ID NO: 27 - DNA, 2924 bp, Eucaluptus grandis
ttcctctccccccacttcctttttgccctatctgatagggtttctcaccttcttcccccctccctctcatgcattcttgcccgctagcagccctgcaaatcgccctgaccttcttgatcgtcgtctcgggatccgccttttttgctctctctcgagggttttcgggtcgcgaccgtttcggagcccgcctcccggagtcaccggagccgttcccatgtcgaaggtcctcagattcactggaggcgaggatttttactctgggaggtcaatataccaaagcccaaaggaggtcaacctctttttgtcccttggtaaccatgtggacgtgtattttcctcctagcaagaggtcccgcatcagcgctccgtttgttttcagtgaggacctattcgagcagaaaaggcaggacacaatcgaagttcttccagatgagtgcctctttgagatattcagaaggttgcctggaggccaggagaggagtgcctgcgcttgtgtctccaaacgctggctcaatcttttaagcaatatatgccccaatgaacgcagctctggtaaatctcagaacaatttggatcctacctgtgggggagaggaagtgagttcagaggacgatggatttctctctaggagcttggaagggaaaaaggccactgatatccgtcttgctgccatagctgtgggaactgctgatcgtgggggattgggcaaactttcaatcaggggtagcaagttgtcccatgtgacaagccttggtcttggggcaatagcacgcagttgcccctctcttaaggccctgtccctttggcacctaccttctgtcggagacgaaggtttactcgaggttgcaaatggttgtcaccagcttgagaagctagatctttgccagtgtcccaacattaccaacaagtttttggttgcagttgcaaggaactgccctaatttgaccgacatatcaatagagtcttgttctagcattggaaatgaaggtttggctgctgttggacagttctgccagaatctgaagtccatttcaatcaaaaattgccccagtgttggagatcagggcattgttggtctgatttcgagggctggtagtgccttaacaaagttcaaattgcaggcattaaacataactgatgtatctcttgcggtcattgggcactatgccacggctgttaccgatttaacccttgcgagcctccacaatgtcacagagagagggttttgggtcatgggcaatggtcatggcttgcaaaggctgaggtctttgatagtcaccgcttgtcggggtgctactgatctgggacttgaatctctggggaaaggttgccctaatcttaagcagttatgcatccgttcatctgcattcctgtcagatggtggccttgtttctttcatgaagtcagcaaggtcacttgagagcctgcaattggaggagtgccacaggattaccctgtcaggactatatggtcttgtcgttggttgtggggataaactgaaatctcttgctctgacaaattgctggggatttaaggactttgattttggatcacctcaagtgtctccttgcaagtccctgcgctctttctctgttcgcaactgcccaggctttggtgatgcgtgcttggtggcacttgggaagatttgcccacatctgcagcaagtagaattgagtgggcttacaggaataacggatgaagggcttttacgactgcttgaatgctgtgaagctggtcttgtgaaggttaacctcagtggatgcatcaacctgacagatcaagtggtttcagcaatggctaagttgcatggtaggacccttgaggtgctaattctggatggttgtacaaaagttagtgatctgggcttgctggctattgcagaaaattgccaactgctatctgatctcgatgtctcgaaatgtgcaatttcggattttggattgatggcattggctcgttctagtcaactgagtttgcaagtcctttccgtgtctggttgctctttggtgtcagacaagtgcttgcctgctcttaagaaagtgggccgcacccttttaggtttaaatctccaacattgcactgcaatcagcactcgttcggtggacctgcttttggaagagctttggaggtgtgacattctcgcttgattgagagtggatggaaattgcagtttcgtctgaagattggatttatttgttatgaagactagagttcaactcggcctatgtggacagctacagtttgtgttagtttttggatccagaatccagcggatatgggtgttgaagcaaaatccggtgcttggtccttttttcagggaatatggcctttcttttttggcaggcttccgaattgggaatctgttcttagtagttttgcctctccaagacgagaggagtcatttatggccagattttcctgagaatgtcctgaccaagttccggttcagttcatcatcaatttcgacagagtttttatgatgcctgggttggtatctgctgttttagctcggcatcatgctggtcaactatgctggcttgtgatcaacttttctccgcgtctggatccttgcacttgcaggaatatttcggttctgacaggtctttcttgttccagatccttgtatgtcatgggcgggtcattctccagagttttggtgacggtcgcggttgcttttcatgcttacaatgccttggattcttgggcttaggccatggcagctgctcaagcagtcttgccatcacaacccatgaggttgtttttttctagccaagccttgtttttcccggcattgcggtgtggaaagtttcttcgaccgtttcgccacacgttgttagaatctccctcccccctgactatatgttggttttacagtttgtcaagtgaaataaaagcagtgtacttgttcatgttctaaaaaaaaaa

SEQ ID NO: 28 - DNA, 1928 bp, Eucaluptus grandis
ggtaacattgaggtcctcctctgcacgtttctccttcgtcatcggggttctcttacctagggtttgcaggcgggcgccactcttctccgctgtttctacctctctcgtttggcagccatgggagaatccaggagaggagagatggatggaacgactcgagggggcagcaatgcggacatgtatctgccgaattataagctcgggaagactctgggcatcggttcgtttggtaaggtgaaaatagcggaacacgtgttgactgggcacaaggtcgccataaagatcctcaaccggcgcaagataaagaacatggagatggaagagaaagtgaggagagaaataaaaatcctcagactctttatgcatccgcacatcatccgactttatgaagtcattgagacgcctacggacatttatgttgtgatggagtatgtgaagtctggggagctgtttgattacattgtcgagaagggcaggttgcaggagaatgaagctcgcaacttttttcagcagattatttccggtgtggaatactgccataggaatatggtcgttcatagagatctaaagcctgaaaacttgctgttggattctaaatggaatgtgaagatcgcagatttcggtctgagcaatataatgcgtgacggtcatttcttaaagacaagttgtgggagccccaactatgccgctccggaggttatctctggtaaactttatgcggggcctgaagtagatgtatggagctgtggagttatattatacgctcttctttgtggcacactccctttcgatgatgaaaacatacctaaccttttcaagaaaatcaagggtgggatgtacactcttccaagtcacttatcggcaggttcaaaggacttgatcccaaggatgcttatagttaatccaatgaaacgaatcaccattccagagatccgtcagcatccttggtttcaagctcatcttccacgttatttggccgtgcctccacctgatacgatgcagcaagcgaaaaagattgacgaggaaatactccaggaagtggtcaacatgggttttgagcgcaatcaacttgtcgaatcacttcgcaaccggattcaaaatgaggctactgttgcatactacttgttattggataaccgtttccgaccttccaatggctacctcggagacgagtttcaagaaacgatggagtgcaccttcaatcgtggaaatccaggggagcttaccattccaactgttgggcctcgctacccactacctggatatatggattaccagggagtgaattcaaaaccaggttattatggtgctgagaagaaatgggctcttggtctccagtctcgagcccatccacgggaaataatgactgaagttcttaaggcgctgcgagaactaaatgtgtgctggaagaagattgggcactataacatgaagtgcatgtggaatccttgtgttcccagtcatgagagcatggttagcaatcctgtccagagtaattattttggtgatgaatctacaataatcgagaatgatggcgcaaccaagtccagaaatgtggtcaagtttgaggtgcagctttacaaaacgacggaggagaaatatttactcgatttgcagagggtgcagggaccccagtttctgtttttggacctctgtgctgcttttcttgcccaactccgggtcctttaggaagagaagggtgaagatatccacgaaaagtcctgccaataaaacttgtgaataaccattggaggattttaggcgttcaacattcatcaggaaattgatatcaagctttttgttctatatcaaaaataaaacgttaaagaaaaactcgtggaaaatacagttttgtaccaactgacgaggtcgtttcagatgttgtgtacttaatcgaaagtgatctttatttacacttaaaaaaaaaa

SEQ ID NO: 29 - DNA, 1140 bp, Eucaluptus grandis
gaaggggggctctctgttttttttaacgaggaaggaaacaagcacgtcgtgcaacttgccgtgtagctctcgaaaacgcccctccttctctctttctctctcttctctctcttctctctttctcctgggtctgagcaagaaatggcagggtacagagcagaggatgactacgactacctcttcaaaattgtcctgattggggactctggcgtgggcaagtccaacctgctctccagattcaccaggaacgagttcagcctcgagtcgaagtccaccattggggtcgagttcgccactcggagcttgaacgtcgatggcaaggtcatcaaggcccagatttgggacaccgctggtcaagaaaggtaccgtgccatcactagtgcttattaccggggagctgtgggcgcattacttgtgtacgacgttactcgtcactccacattcgaaaacgtggagagatggttgagggaattgagggatcacacggaccccaacatcgtggtcatgctcgtcggcaacaagtccgatctccggcacctcctggcagtctcaacagaggatgggaaatcatttgcggagagagaggccctcgtcttcatggaaacttctgcactcgaggcgaccaacgtggagaatgctttcgccgaagtcttgactcagatttacaacatcgtgagcaagaaggccctggaaacaagtgagcaagcaaatggctcggctgtgccgtctcagggagagaagattgatgttggtaaggatgtgtcagctgtcaagagaggtggatgctgctcaagctagtcagattcttggaacattcgagagttttggattactgggtagttgccgtttttcctgtcatcatattttgcgatatatagcgtgagatattttttctgcacgacactggccgatccggtctagattgcaggtacacgaatttgtatcatttatgtcagcgatttcttgtgatgggtacagagcttaatttaggaaactgcttgttaattttacatctattggttcattaccatgttggtcttcttttgtttttaggacacaatgtattaggtgcttgatgctagcgcggacacattgtattattttccgagggaatcatgacgttgaattggaaaaaaaaaa

SEQ ID NO: 30 - DNA, 1011 bp, Eucaluptus grandis
ccaagctgtcttcatcatttctcgctgggaatcaatttgaattcgattcgatttcgccgtgtcgatcgaggatcgctcgatcgatcgatcgatcagaatccccagttcgtctgaatccttctctccctccctccctctctctctctctgtgtctctctctcgccatttccgtgagatccagctatggactcctctcgcgagagcctggtctacgtcgcgaagctcgcggagcaagccgagcgctacgaggagatggtggatgaaatgaagaaggttgcgaagctcaatgttgcattaaccgttgaagagagaaacctgctatctgttgggtacaaaaatgttattggggctcggagagcatcctggaggattctgacatccatagagcaaaaggaagatgcaagggggaacgagatcagtgtgaagcgaatcaaagagtacaggaagaaggttgaatcagagctctctagcatctgcagcgatatcatggtcatacttgatgagcatgtcattccttcagcatcagacggtgaatccaaagtattttactataagatgaagggagactactaccgttatcttgcggaattcaagagtgatgacgagaagaaagaggttgctgaacagtcaatgaaagcttatgagatggctacaagtattgcagagtccgatttgccttatacacatcccatccgccttggtttggctttgaatttttcggtgttttactatgagatcctcaactcagctgaaagggcatgccacatcgcaaagcaggcatttgatgatgcaattgcagaacttgacaacctcaatgaggagtcttacaaagatagcactttaatcatgcaacttctcagggacaatctcacattgtggacatctgacatcacagaggaaggagaagatgcacaaaggataaatggctcagctaaagttggcatggaagaaggagagtaaaacaggtgtaaccctgaatcatatgccttgcagtgggtcgacgcggccgcg

SEQ ID NO: 31 - DNA, 2270 bp, Eucaluptus grandis
cgtttccgcgcttctgctcgcgcgtcctctcgctcgaggctttccgcttccttcttccgaaccccttaaaggtcgggtctttccctcccccctctcgatggatccggccgccggctccggctccggctccgggctgatccgattagggttcttggccggctccgacgagtgagctgtcgcccgcctcctcgcgggcggttttccggcggcgggtttagggttttgccctttttccgttcttgagagagagagagagatagatagagagagagaggggggggaggtgatggaggatcggaacgtgaagaggccggacagcccggggctttccgacatcgtgttgacctgcgtcatgccgtacatcgacgaccccaaggatcgggacgcgatttccctggtctgccgccgctggtacgagattgacgccctcacgaggaagcacgtcaccatcgccctctgctacaccaccagccccgaacggctgcgcaggaggttcaggcacctcgagtcgctcaagctcaaggggaagccgagggccgccatgttcaatctgatacccgagaattggggcgggtacgtgactccctgggtgaccgagatcgcgcagtctttcgattgcttgaagtcgcttcactttcggcgcatgatcgtggaagattcgaacttggaggtgctcgccacgtcgcggggacgcgttctgcaagtgctcaaactcgacaagtgctctggtttctcgaccgacgggcttttacacgtggggcgtttatgcaagactttaagaaccttctttttggaagaaagcacaatcattgagaaagatggtgcgtggcttcacgagcttgctatgaacaacacagtccttgagactttaaatttttacatgacagagctatccagttttagtgtccaggaccttcaaattattgccagaaattgtcgatcgttaacatctgtgaaaattagcgattgcgaaattctggatcttgtgggtttctttcaagatgcagctgctttagaagaatttggtggaggtctttttaatgaggaaccagaaaggtatgctgctttatcgttcccagcaagattatgccgtttgggtctaacctacatttcagagaatgagatgcctatcgtgttccctattgcatctcggctaaggatgttagatcttctctatgcatttcttagcacagatgacctctgcttgctgattcagcaatgccccatcttggaagttcttgagacaaggaatgtcattggagacagaggattagaggttcttgctcatagttgtaaaaggttgaagaggcttaggattgaaagaggtgctgatgagcagggtatgggggatgaaggaggccttgtttcgcaaagaggattaatggacttggctcggggctgcctagaactggaatacctggctgtttatgtatctgatatcacaaactcatccctcgaatgtataggaacttattcgaagaacctttgtgatttccgtcttgttctacttgaccgcgaggaaaagataactgatttacccctggacaatggtgtcagggctattttaaggggatgtgaaaagctaagaaggtttgctctttatctgcggcctgggggcttgacagatgtgggtcttggttacattgggcagtatagccaaaacataagatggatgcttcttggatatgtgggagagagtgatgagggccttagggagttctcccgaggctgcccgagtttgcaaaaacttgaaatgcggggttgttgctttagcgaacaggcgctggctgatgctgtgatgcggttgacttctttgaggtatgtctgggtgcaggggtatagaggatctgacaccggtcgagatattctggcgatggtccgtcccttttggaacatcgagttgattcctgctagaagaatagctgttgccaatcagaatggggaaaacgtgcttaatgaagacccagcccatatacttgcatattactctctagcaggaccaagaaatgattgtcctgacagcgttatacctttggctccagcaaggctgcttaccttgtagagctgtatatacacccttttgccgaagatgtcttttatcttcttaagtgctctagaccccctgtcatacggttctgtattttatcactcctccctgagaaatttctcctcttgctttacttttcgtcttccgtttgttggaattccttcttttctcttttattttgtcgcaataagattgtgtactttgtaaaaaaaaaaaaaaaaaa

SEQ ID NO: 32 - DNA, 838 bp, Eucaluptus grandis
aggtttgggttttttttttttttttaggggcgatcgggggatggcgaaccgggtggatcacgagtacgattacctgttcaagatcgtcttgatcggggactccggcgtcggcaaatcgaacatcctctcgaggttcacgaggaacgagttctgcctggaatctaagtccaccatcggcgttgagttcgcgacgagaaccctgcaggttgagggaaagaccgtcaaggcacaaatatgggatactgctggtcaagagcgatatcgagccattaccagtgcatactacaggggagcagtgggcgctttgctagtttatgacataacaaagaggcaaacctttgacaatgtccagaggtggcttcgggagctgagggaccatgcagattctaacatagttattatgatggctgggaacaagtctgatttgaaccacctaagagctgtcccgggggacgatggtcaagccctggctgagaaggagggtctttcatttcttgagacttcagcattggacgcaacaaacattgagaaggcgtttcagacaattttgacagagatctaccacatcataagcaaaaaggcattggcagctcaggaagctgctgctactacgcttcctggtcaagggaccacaattaatgtcgctgatgccacagggaatgccaacaagagaggctgttgttctacttaaggcgacactgtgattcaggagacaaaatttgagtggtaattaaccccagcagcttagatatgagcccattttcttttgggtcaacgagacatttgtagaatatttgtggtgttcttttcctcccccgttttatttttctttttactc

SEQ ID NO: 33 - DNA, 1314 bp, Eucaluptus grandis
gcctcgtgccgaatgcaaggcaaacaagcaagtgcattatcttcgttctgagtgagagagagagagagagagaccaaaagacaagcaaggtttcactacagcttctagagagagaaaatggagagcttcccagtgatcaacatggagaacttgaatggtgagaagagagcaatcaccatggacaagatcaaagatgcttgtgagaactggggcttctttgagctggtgaatcatgggattccacccgagtttatggacacgatcgaaagcatgacaaaggggcactacaagaagtgcatggagcagaggttcggagagctggtggcgagcaaggggctcgagtgtgtccagacagaggtccacgacttggactgggaaagcaccttccacttgaagcaccttcctgtctctaacatctcccaaatcccagatctcgatgatgactacaggagagtcatgaaggagtttgcactgaaattggagaagctggcggaggagctcatggacctactgtgtgagaacctgggcctggagaaaggctacttgaagaaggccttctacgggtcccaaggaccgaacttcggcaccaaggttagcaactacccgccgtgcccgaagcccgacctgatcaaggggctccgggcccacaccgacgccggtggcatcatcctgctcttccaagacgacaaggttagcggcctgcagctcctcaaggatggccagtgggttgacgtccccccaatgcgccattccatcgtcgtcaacctcggagaccaaatcgaggtgataactaatggaaagtacaagagcatactgcacagggtggtggcccagaccgatggaaacaggatgtccatagcttcattctacaacccaggcagcgacgccgtgatctatccggcaccggcacttgtggagagcgaggcagaggaggccagcaaagcagtttacccaaagttcgtgttcgaggactacatgaaattgtatgctgctctcaagttccaagccaaagagccaaggttccaagccatgaaagccatggagtcgagccccagtttgggcccaatcgcaaccgcttgatttggagaatttaggacttctctaagtgtggacgcagaagaataaattggctttttttttattattatttttaggttatgattggaccaactgaggagattctatccatcagtttaagtacatatttgaactctgtcccaatatgtactttgatttatggattgtaacgatgtactcaattggaaataataggagcgaaagatcatttaaaataaaaaaaaaaaaaaaaaaaaa

SEQ ID NO: 34 - DNA, 1266 bp, Eucaluptus grandis
gagagagagagagagagagagagagagagaccaaaagagaaacaaggtttcactgcaatttctcaagagagaaaatggagagcttcccagtgatcaacatggagaacctgaatggtgagaagagagcaatcaccatggacaagatcaaagatgcctgtgagaactggggcttctttgagcttgtgaatcatgggattccgcccgagttcatggacacggtcgagagaatgaccaaggggcactacaggaagtgcatggaccagaggttcagagagctggtggcgagcaaggggctcgagaatgtccagacggaggtccatgacttggactgggaaagcaccttccacttgaagcacctccccctatccaacatctcccaagtccctgatctcgaagatgactacaggaaagtcatgaaggagtttgcagtgaagttggagaagctagcggaggagctcatggacttgctgtgtgagaacctgggcctggagaaaggttacttgaagaaggccttccacgggtccaacgggccgaacttcggcaccaaggtcagcaactacccgccgtgccccaagcccgaactgatcaaggggcttcgggcccacaccgacgctggcggcgtcatcctgctcttccaggatgacaaggtcagcggcctacagctcctcaaggacggccagtgggttgacgtccccccgatgcgccactccatcgtagtcaacctcggcgaccaaatcgaggtgataaccaatgggaagtacaagagcgtgctgcatagggtggtggcccaaactgacgggaacaggatgtccatagcttcattttacaacccgggcagcgacgccgcgatatatccagcaccggcactcatggagagcaaggcagaggaggccagcaaagcagcttatccaaagtttgtgttcgaggactacatgaaactgtatgctgccctcaagttccaggccaaagagccaagattccaagccatgaaagtcatggagtcgagccccaatttggagcctattgcaaccgcttgatttgggaaattctttttcgcaattctttgcttgcaaaagatgtagtcatacacattatggaagtcctctagggttagaaaggactctgaattttttggtggtggaaggaaattttttcctaccccaaacttgataaaaattgtcattgtgactcatgttagtatttgacatgattcgtgttaaattatttatgaaatattgcatgttatagtcaaaaaaaaaaaaaaaa

SEQ ID NO: 35 - DNA, 1543 bp, Eucaluptus grandis
gcgaggacatcatcaccaacgccgccatcgaagaaggggcgaatctgaagcgaaagaagagatgagcggcggcagcgacctccctgaagagatcctgatccagatcctcctgaaattgcccgtcaagtcacttgtacgattccgatgcgtctccaagtcgtgggactccctcatcacccacccatccttcgtctccctccacctccgccacgccatggcgggccacgaccgctccgtcatcctcctccggcactactccctcacccagcgcaaggagcggaacaccctctacctcgacggggagtctttcttggagcaccaggagctcgaattccccttgaagacccacgacacttactacctcgccggctcctgtaatgggttgctctgcttttccgactatatcatcaacaacctccaggtaatcctctggaacccttccctcaggaagtgcgtgcagttgccgatcccgcggttcattgatactgatctcacgcacacgtatgttctcgggtttgggttcgatacgcggcgtgtcgattacaaggtcgtgaggttgatttacattctggggaagaattggtccgtgatagtgccaccggaggttgagatctatgagcttaaaactaatgcttggagagggatccagacggccgttccttatgtcataccagaatcttcgtcgcaggcctttgtgaatggggctatccattggattgggtataacccagctgataggcgattgaaggtggcttcaagtcctaggtcgattgtggtattattcgatatgcaggacgaggtgtttggggaaatggagttgccgaaaggtggggattatgcgaacaggctgaatttgtcgctggctgtgcatcaagatttgatttgcttgttgcattgccatccgatggaagaagatgggcatcagttgtatggggtttgttgggtctgggtcatgaaagaatacggcgcagcagactcctggactaagctgtttaccattaacatcagtgaacacggcgggatcgggaggattttaggttttaggaaaaagggggacgctctgctcgtgactcacaatgacgagctggtttcatatgacttgaggggtcagagaattagtcggcttggattgtatggtgttgcgagatcttttgaagtcatcccatacatggattgtctaattttagtgtgaggagagcacacactctccagacaaccatatttcatggctggttaggttgtaggtagattatgttggatttcgctctcctgaaggagtgaagcatatgacacaaataatggagaaccagagtgattagagatacttagactttagttgttgtatacgggttgattgctgttttctctagaagttattctggactagtgaagtatgtccttttacttatctgaatgattttttattttttgggagtttcagatggttgattggatgtatgctactgaaagttggggcttctattgctactgccagttgccctagcagaagaatgataataatttctttgttccaaaaaaaaaa

SEQ ID NO: 36 - DNA, 1003 bp, Eucaluptus grandis
cccgtagcgtcgaccacgccaactacctttcattcgtgcccgtcgatactccaacgaactccagtcctcctccccctctccgtctcggtcgcgctccccgcacgccgaccttcgatttcgaccagcggttctctcgagctcccgcgcgtccgccgatccgagcgtccgccggattcacctcgtcggagccgccatgggttgctcctcttcgcttccagatagggcttctgggagattgggcgggctcaattcggagaacggtgcagtgaacgacgcgaagaacctgcgtgttaagcttgtacttctaggggattctggtgttgggaaaagttgcattgtacttcgctttgtccgtggtcagtttgatccgacatctaaggtgactattggagcatcgttcctgtcacagaccatagctttgcaagattctacgacagttaagtttgaaatatgggacactgctggtcaagagaggtatgctgccctggccccactttactatcggggtgctgcggttgcggtagtggtttatgatataacaagcccggaatcatttcaaaaagctcagtactgggtcaaggagcttcaaaaacatggaagccctgatatggttatggctctggttggaaataaagctgaccttcaggagaatagagaagtgacggtccaagatgggattgactatgctgagaagaacggcatgtttttcattgagacatctgctaaaactgcagataatataaatcagctgtttgaggaaattgccaagcgacttccacgtccaacaccgtcatgattgggaagttcataccgtgtttaaagccgcagatgatgttattggagtcttcaacggcggtgatgtaaaatatctatcccaatgtatacctcctgtcctggaattctttggtcgacagttactttcatttgtccatgaattcactccacataagttgtaagatgatcaatcctcaattgtaccagagagagcttgcgaaaaaaaaaa

SEQ ID NO: 37 - DNA, 1711 bp, Eucaluptus grandis
gcagcagcaggcgcagcagaaaggaaacaaaaacagggaggaaaggaaaacgacctttcccactcaaaagctcctccctttttcatttgcatttctgcatccacacaggcacagggagacaaggggaccgagtcagtgagtcggaacggttgaccgcggaatctcccccccccaacaaaaagccatcgcccaactcaggccaacagtcaaaacccaccttaaccgaattcccccagatcaatcccctctctctctctcctccactgtaacggaatcgcgacccccaaatcctagggctttctttctctctctttctctctctatttctaccaccaccatcaccaccaccgatggacggcggggctcctcagccggcggataccgtcatgtcggaggcggcgccggcgcagcagcagcagcagcagccgcagcaggcgcagccgcaggggatcgagaacatcccagcgacgctcagccacgggggccgcttcatccagtacaacatcttcggcaacatcttcgaggtcaccgccaagtacaagccccccatcatgcccatcggcaagggcgcctacggcatcgtatgctcggctttgaattcggagacgaacgagcacgtggccataaagaagattgctaatgctttcgataacaagatcgatgcgaagaggactctccgtgagatcaagcttctccggcacatggaccatgaaaacgttgtggcaattagggatatcattccaccgccacagagagaggtgttcaatgatgtttatattgcatatgagcttatggacactgatctgcatcaaattattcgttccaaccaagcattgtctgaggagcattgtcagtattttctatatcagatcttgcgaggattaaaatacatacattctgcaaatgttctgcatagagacttgaagcccagcaatcttctcctaaatgcaaattgcgatttgaaaatatgtgattttggactagctcgtgtcacttctgaaactgattttatgacagaatatgttgtcacaagatggtaccgtgcaccagagctattgttaaattcttcagactatacggcggcaatagatgtatggtctgtaggctgtatctttatggaactaatggatcggaaacccttgtttcctggcagagaccatgtgcaacagctgcgtttgttgatggagctgattggcaccccatcagaggcagagttggggttcttaaatgaaaatgctaagaagtatatcagacagcttcctctgtaccgtcggcaatctttcactgaaaagtttccccatgtccacccacttgcaatcgatctcgttgagaagatgttaacgttcgatcccaggctgaggctcacagttgaagaggcattggctcatccctacctaaactcactgcacgacatcagcgatgagccgacttgcatgaatccattcaacttcgactttgagcagcatgcactcacggaggaacagatgagggagttaatttatagggaagcgcttgcatttaatcccgagtatctacagtaatggaagtcatgctgttagtatttggtggctgttctcgagtgtgatgcccgcgctttaacatggcgatgatttatttcttcatgtacatatggtttatcctattgttggatggctctgctattgaattcttttcatgacttcgagaaccataagaattttcaaaaaaaaaa

SEQ ID NO: 38 - DNA, 1505 bp, Eucaluptus grandis
ttccctcttcctcttcccttccgtttcgagctcgctccatctcctccgacgaaagatccgagccccctcctcctcccccagcaccatccgggcccgattcgggtcgggtcgggtcgtccggagcggaccctctcctccgcgctctcctccgatggagtcgtcgagctcgggaggtgcctcggcggagcacagcgtccgcgggatccccacgcacggcgggcgctacgtgcagtacaatgtgtacgggaacctcttcgaggtctccaggaagtacgtccccccgatccgccccatcggccgcggcgcctacggtctcgtctgcgctgccatgaattcagagacaaatgaggaggttgccatcaagaagattggcaatgcgtttgacaacagaatagatgccaagaggactttacgagaaattaagcttttatgtcatatggatcatgagaatgttattggccttaaagacattatacgtccaccaagtagggagaactttaatgatgtttacattgtgtatgaattgatggacactgatctccatcaaattatccgttccaatcagccattgactgacgatcactgcaggtacttcttgtatcagttgcttcgaggtctcaaatatgtgcattcagcaagtgttctgcatcgcgatctgaagccaagcaacttgtttctgaattcgaattgtgaccttaaaattggagactttgggctagctaggaccacatctgaaacggattttatgactgagtatgtagttactcgctggtatcgtgcaccagaactgctccttaattgttcagagtacactgctgcgattgatatttggtctgtgggttgcatacttggtgaaattatgactaggcagcccctatttccaggcaaagactatgtccatcagctgagacttattacagagcttataggatctcctgatgactccagccttgggtttttaagaagtgataatgcacgaagatatgtaagacagcttccacagtacccaagacagcaattttctagtagatttcagactatgtctccaggtgctgttgatctcctagaaaggatgctcgtctttgatcccatcaggcgaataacagttgaggaggctttgtgccacccttatttggcccctctacatgatataaatgaggaacccatttgcccgactcccttcatttatgactttgagcaaccgtcatttactgaagaaaacattaaggagctcatttggagggagactctgagattcaatccagatcccatgcattagggatttgcgacaggttgtcgctttgtttagtaatgttctacacttaactggttggatgtttcattcaaaaaatgaaacaagtgtgctgtagatagcgaaattagttttgaagttttctacacagctggacaaaagttctttgagcttggatgctatgtatgcttgtaatgttcaacttgttcagccgatgataaaaggtcttcactcttgaggcttaaaaaaaaaa

SEQ ID NO: 39 - DNA, 1852 bp, Eucaluptus grandis
gcccaagttcgcatctttcgtcctttccccacgtacccatttgctcattccgccggaattcggccggaattcctcccccgccgccgcaatggggcaggtcccgtcttccgcctcctcctcccccgagcccagccaccgcggcggcgcgatctcgtccagccaccgcctcgactccctcccctccctcgagttcgtctcgtcgttcgaggacgaggaggacgccgccgccgccgacgagggggccgccgctgggtacgactacaccggcgacctccccgacgagtgcctcgcccacgttttccacttcctcggcaccggcgaccggaagcggtgctccgtcgtgtgccggcggtggcgccgcgtcgacggggagagccggcaccggctctcgctgaacgcgcaggccgacctgctctcgtcgctcccctccgtgttctcccgcttcgacgccgtcacgaagctcgcgctccggtgcgaccggaagtcggtcagcctgggcgacgaggcgctggtcctgatctccctccggtgccgcggcctcgcccggctcaagctccgcggctgccgcgaggtcaccgatctcggggtcgcggccttcgccgagaactgccggcagctgaggaagctctcctgcgggtcgtgctcgttcggcgcgagggccatcaatgcggtgctcgaccactgcgtgaatctggaggagctgtccatcaagcgcctccggggaatccacgacggcgccgagcccatcgggccgggagccgcggcgaagtcgctgagatccatttgcttgaaggagctcatcaatggtcagtgcttcggtcctctcctggtcggagcgagaaagctctcgactttgaagttgattcgctgtctgggcgattgggacaatgttctccagacaattgggagctcaaatccaggtctattagaagttcatttggagagaattcaggtgagcgatggcggtctttgcgggatcgcgaactgcaagggtatcgacagtctgcatgtcgtgaaggtccccgagtgttcgaatttaggtctttctagcattgctgagaattgcaggcaattgaggaagcttcacattgatgggtggaggataaacaggataggcgacgagggtctggtcgaggtcgccaagcagtgcctccagttgcaggagctggtcctgatcggcgtcagcgtgacccattctagcttggccgcaatcggttccaattgcaggaaattggaaaggttagccttctgtgggagtgacacggtcggtgatgcggagattgcgtgcattgccgccaagtgcgaggccctgaagaagctctgcattaagaattgccccattactgatgtcgggatcgaatcccttgctcaggggtgtcccaatctggtgaagattaaggtgaggaagtgcaggggagtgagcgggcaagtggtggagctgttgaaggagcggagagggtcgctggtcttcaatttggatgcctgtggaatcgaagcattggacgatatcagaggagttcaagaaagtgttatggagttccctcctgtgaatacttccgatgcgccgtcgagtagcaatgagaggtcaatgttgtttagggcgaagctaggtcttttcgcgggtaggaatttagtggcctgcaccttcaggaggtggtcaaatggtgaacatagcaccaatggaaacttgtgaattccaattgttgtaagcgctgaaaattgttttgttgacatttcgttgtgtttagaccttccctaggcaattcttgttcgcaatgatgtacctattatcgcccttttgcctcgtgcaacttttcttggaaatgaaactcgagttcttttaaaaaaaaaa

SEQ ID NO: 40 - DNA, 2267 bp, Eucaluptus grandis
ggctccaaaacaaccaaataactcacactgagctcttcctcctcctcctcctcctccgcctctatatggccgtccagatctaaacaccacttctgcccttctctctctctctctctctcttgcctttccctcggagccaatcaagaagaagctagagctccggtcctcgctcccgagattcatggcgtactcgttcccggaggaggtgctggagcacgtgttctccttcatcggctccgaccgggaccgcaatgccgtctccctggtgtgcaagtcgtggtacgagatcgagcgctggtgccggcggcgcgtcttcgtcggcaactgctacgccgtcagccccgcggccgtcgtccggcgcttcccggaggtgagatccgtcgagctcaagggcaagccccacttcgccgacttcaacctcgtccccgagggctggggcggctacgtctccccctggatcaccaccctggcccgcgcctacccttggctcgaggagattcggctcaagcggatggtggtcaccgacgagagcttggagctgatcgcccgctcgttcaagaacttcaaggtcctggttttgtcctcttgcgaggggttctcgaccgacgggctcgccgctgttgccgctaattgcaggaacttgagggagcttgacttacgggagagtgaagtggaagatatgagtggacattggctcagtcatttccctgattcatatacatcactcgtatccctcaacatttcctgcttaggctctgaggtaagcttctctgccttggagcgcctggtgagtcgctgccccgacctgaggtctctccgactcaaccgcaccgtgccacttgatcgccttgccaatttacttcgacggcccccacagttggctgaattgggcacgggcgtttattctgctgaactgaggtctgatgatttctcgaatctagttggtgctctagctggctgccgagagctgagaagtctgtctggattttgggatgtggtacctgcatatcttccagctgtatatcccctatgctcagggcttacatcgttgaacttgagctatgctaccatccaaagctctgaacttacaaaacttatcagtcaatgtcacagtctgcagcgcttatgggtacttgattatattgaagacagcggtttggaagccctggctgcatgttgcaaagatttacgggaattgagggtgtttccctctgagcccttcaaccgtgaaggaaatgtatctttaacggagcagggccttgtgtcagtgtctgagggttgctccaagcttcagtcagttttgtacttctgccgccagatgtctaatgcggccttacttaccatagctcggaaccgtcctaacatgactcgattccgactttgtatcattgaaccacgttgtcctgattatataactcatgagccactcgatacaggctttggagccattgtccaacactgcaaggatctccagcgtctctctctatcaggtcttctaactgaccgtgtgtttgagtacatagggacttatgcaaagaaacttgagatgctttctgtggcattcgctggagacagtgacttgggactgcaccatgtgctatcggggtgcgacagtcttagaaaattggagatccgggactgcccgtttggtgacaaggcgcttttggccaatgctgcaaagctggagacaatgcgatccctttggatgtcttcttgctcagtgagcttcggagcatgtaagctgcttggtcagaagatgcccaggcttaatgtcgaagtcattgacgagagaggccacccggattcaaggcctgaaagctgcccggtcgagaagctttacatctatagaacggttgcaggtccgaggttcgacatgcctgattttgtttggacaatggatgaggattctgctctgaggccttcttgacagctttcattcaaccgtttgctttttttcctcgtggcactatggtgtggtgactgtgacagtcaaagcaggtacatgctcttcaccgccctctttcatgcaggtctaatttctttttagcttagtattagcagctgttattggtggtgacattagctgtgggaagggtatatggaggctcaagagctctttagccgaagattttgcacttggctgagctatggataccaatgcattgttaaataaaagaggaccctttttgcttttgctgttgttgttgttattgttgctgttgtatgtgtatcaagacatggttatttaatttgggttaaaaaaaaaa

SEQ ID NO: 41 - DNA, 782 bp, Eucaluptus grandis
ctccttcttcttcctcttctctctctctttccccccaacattttcacgaacacctgccggacggagagagacctgcagctgggttgccggagaggaagagggagagagggacaatggcgcagtacgaggaggacaacgccgagttctacgtgcggtactacgtgggccacaaggggaagttcgggcacgagttcctggagttcgagttcaggcccgacgggaagctgcggtacgccaacaactccaactacaagaacgacatcatgatccgcaaggaggtctggctcacccccgccgtcctccgcgagtgccgccgcatcatctccgagagcgagattatgaaggaagatgatagtaactggccagaacctgaccgtgtgggacggcaagaacttgagattgtaatggggaatgagcacatttccttcactacctcaaagattggttcccttgttgacgtgcagacaagcaaggaccctgacgggcttcggatattctactatcttgttcaggacttgaaatgctttgtgttctctctcatctccctccacttcaagatcaagccaatctaaggaggacttcttccaagcatctgaatcccaattgtttgatccttttggcggtagcctcgtggtctgtcattgattgagcagcatgcatattgtggtattgtgcactttgagtattgactggtggaatctccttgttgagttttgggtttgtaactaaaagatgcttttaactcgaaatgccagacacctctctctctctcaaaaaaaaaa

SEQ ID NO: 42 - DNA, 1027 bp, Eucaluptus grandis
ggcattgttccttcgcagtcgagtcgagtcgagttcgcttcccgctgccgctgacgaagggtcccatctgctcctgctcctgctcctgctcctgcttcggcttcatcccgctctccttttctctgcttcttcttcttcttcgtcttcttccgaccaatcccccaaaagagaagaggaggaagagggagggataaagtagggggaggaggggttggaaatggcgaggagagcggaggaggagtacgattacctgttcaaggtggtgctgatcggcgattccggggtcggcaaatccaacctcctctcccgattcactcgcaacgagttctgcctcgagtccaaatccaccatcggcgtcgaattcgccacccgcaccctccaagttgagggaaggactgttaaagcacagatatgggacaccgctggccaggagcgatacagagcgatcaccagcgcctactacaggggtgcccttggggctcttcttgtatacgatgtgacaaagccgactacttttgacaatgtgagtcgatggctgaaggagctgagggatcatgccgattccaacattgtcatcatgctaattgggaacaagactgacttgaagcaccttagagcagtggctactgaagatgcccagagttatgccgagaaagagggcctctcgttcatcgagacatctgccctggaagcgaccaatgtggagaaggctttccagactattctctcagagatatacaggataattagtaagaagcctctgtcctcagaagatgcagccccggccaacattaaagaagggaaaaccattgtagttggcgaatcagaagccaacacgaagaaggcatgctgctcttcgtcttgaagatcatcctatgttcttttcccttaccattgtggtccttgtttccttagtttctctgctggtttatatgttgtctccaatttgtttttcttctttctctttcttttccaattttttgactgtttccaagattattattgggtcatttgacgaaaaaaaaaa

SEQ ID NO: 43 - DNA, 1686 bp, Eucaluptus grandis
gcttttcttttatcccaactctcaaatttattccccgcccactcctccctcatttcccctgcacaggaaaaaagtcggctcacatatatagcttcctgaatgcaatggcagttgattgcctcacaagtaaaacctcaccagccatgcctccgcagcacaaagatgaagccagagaggataaaaaacatctagtttttgacgcctcggtgatccggcaccaacccgacatcccgaaacagttcatttggcccgacgaggaaaagccgtgtgcgaacgccccggatctcgccgtcccgctcatcgacttggacgggttcctctccaaagacccgagtgcctccgaggaggcatcgaggctcgtgggggatgcgtgccagaagcacggcttcttccttgtcgtcaatcacggcgtggatgctggcctcatatcggacgctcacaagtacatggacaaattcttcgggttaccgctcagcgagaagcagagggctcagaggaagctcggtgagcattgtggatatgccagcagtttcactggcaggttctcttccaagctcccatggaaagaaacgctttccttcggctactccgccgagaaaagctcggccaatgtcgtggaagactacttcaagaacaccatgggcgaagagtttgagcaatccgggagggtgtaccaggactattgtgaggccatgagcagactgtctctaggaataatggagctgctaggaatgagcctaggaatcggcagagaccatttcagggagttcttcgaaagcaacgattcgatcatgaggctcaactactaccctccgtgccagaagccggacctcaccctaggaaccggtccccactgcgacccgacatccttaaccatcctacaccaggaccaagttggcgggctccaagtgttcgtcgacaacgagtggcgttccatcagcccgaacttcaacgcgttcgtcgtcaacatcggcgacactttcatggctctatcaaacgggctatacaagagctgtttgcacagagcagtggtgaacagccgaactccgaggaagtccctcgccttcttcttgtgcccgaggagcgacaaagtggtgagaccaccgagtgagctagtcgcaatgtcctgtccgagagcgtacccggacttcacatggccggtgctcctcgagttcactcagaagcattacagggccgacatgaacacgctccgagcattcaccaactggcttcaacagagaacatctgaaccagttcggtgatgaagatttgtcacaagtagagagatctatttggaggtccgaaaagttgcggctaacaaaggggtgaaagagcctctctgccaaagcaaagaagatgacattgacgacgacaaagaagagagatcaaaagggaagtggtgggttttttttaaaggacgttggagagggacaaacagagagttagaggaaaagccaaaatatcttttaccttcaagggtacgtcttctgtagccagatagtactggcacccatgatggtcacgatgatcaaagggcaagagatcaagaaacatgagaaccaataaagagctgtaatacatcagctaatttttgttttgtttttttccttctccttttgtccttggttaaggtagaaaagtttaccccacagtaacccctgccttgatgtaaattttgcattttgg

SEQ ID NO: 44 - DNA, 1065 bp, Eucaluptus grandis
gctcgtgtccacctacaagtcaaattccgcttcgattgtccggtccgactccccgacccaaggaaggaacgacgtcaaaaaaaaaaaaaaatacgaactttctctgcctcaagactcgctaggaagttgtcttctttgagagctccgatcggcatcaatggcttctcgccggcgcatgctcctcaaggtcatcatcctcggcgacagcggggttgggaagacttctctgatgaatcagtacgtgaatcgcaagttcagcaatcagtataaggcgacgatcggagctgatttcttgacgaaggaagttcagtttgaggacaggctgttcacattgcagatatgggatacagctggccaagaaaggtttcaaagtcttggtgtggctttttacagaggtgccgactgctgtgttcttgtgtatgatgtgaatgtaatgaaatcattcgacaatctaaataactggcgggaggagtttttgattcaggccggtccttctgaccctgaaaacttcccatttgtcgttttgggtaacaaggtggatgtcgataatggcaatagtcgtgtggtttctgagaagaaagcgagggcttggtgtgcttccaaaggaaacattccttactttgagacctctgccaaagaaggatttaacgtggaagctgcttttgagtgtatagccaaaaatgctttgaagaatgaaccagaagaagaaatatatcttccggacaccattgatgttgcgggtggagcacggcagcagaggtccaccggctgcgagtgttgaagagtccaacagtacatcaattcccttgggatgcgtatacgatgcggctcaaggtgtatcaattcgtgttacagataccattctcttatgtattgtcaaaagcagagtaaaaaaaaattcttcctaaaggattgatgtagagaaccgttgaacttcccagtgtgcatttgtatcataagccaatcagggagaccttgtttgttttttcatcttttcacacctatttggttccatgatatctttggtcaccctgaaattcttaatatcttttcctaaaaaaaaaa

SEQ ID NO: 45 - DNA, 1502 bp, Eucaluptus grandis
ggaataaaagggcatctacattgacttggatctaaaaagattcgattttttgtatttttccgagctgaatttcaggaattatagcttcctttccagtacccattgaaagagcacccccgtgggccgtcgctgctccctcgcagattcatggagtgagaaatctgaaggggagaacgctgatgatgcagatccgaatgaaaccccacgttgggttcttcctcccggttgccctgcatcgatccctgtcgtcgcttcctccgaatccagtcgcctgacccgtgcaggtacgctcagtgggacattgaccaactctcttgtcctaattttccatcacaagctactatatgggagctagctaggcaccagagcagaaggtgtctgttccggccaatactacctcgatttgtcagctcctattttattgcttgcttgagagtctaattcatattcgtacattaaactcccaaactcttccctcgattgccacatcatcaaccagcaaagacattcaaaactcaaagatgctcaccatctcggatgagaaactctttcacaactgcctgctcgctctctacctcattggaccgcccaccttcatctccctacgatacatccaagccccttatggcaagcaccaccgctcagggtggggccccaccatctccccagcccttgcttggttcctcatggaaagccccactctttggctcacgctcttgattttcccctttggcaaaaactcctccaacgccagatccctcattctcatctcccctttcctctttcactactttcatcgaacaatcatatatccactgcgcatcagatcaagcggtggtcagagaagtactcaaccaaatgctgcaaatcgttttccggtcactgtggccttcatggcatttgggttcaatctcttgaatgcttacgtgcaagccaggtgggtgtctaattacgagagtgacggtgctgctggtgggtggtggttttgggggagattcttggtgggattggtgatatttgttagtgggatgtatatgaacatgtcatcggacatggtgttggtggggttaaagagggaagggaaagggtatcgagtgccaagaggagggttgttcgagtttgtgagctgtcccaattattttggagagattgtggagtggctgggatgggctgtgatgacatggtcttgggccggcttcgggttcttcctctacacgtgcgccaacttggtgcctcgggctcgtgcaaaccacaggtggtatttggataaatttggggaggagtatcccaagagcaggaaagctgtcattccattcttgtattgatcaattcataaggatgcttgcaaacagggaaatgaaaaatatggatgaaactggacgtgatttgtacccaacgtttcttcttgttagagcttttccaagaaaaatttgtaatccccctgaataatggagttactattgatcagtggatattgcttactatgttgttcaaaaaaaaaa

SEQ ID NO: 46 - DNA, 1957 bp, Eucaluptus grandis
gatcaggggcggggccggtggggacaacgagaaagattctctctcggtcgccgccgtcgccgtcgtgtcgccgtcgtcgccagtcacttcgcactgtgtctgccggtctccgctggagctcctctgtaccgctttagcgaagtctactccagcaagtcaagcagactacctaagcaacccgctcctctctctctctctctctctctttctttctctctctatctcatcgatcgagttcactcccgaacggagagaggcggagcggaggaaggaggagagaaaatggcggaagcgaagaccgtgcactcgccgctcgtcacctacttctccatgctgtcgctcctcaccctctgccctcctttcgtcatcttgctatggtacacgatggtgcatgctgatgggtctatcgtccaaacttttgattacctgaggcagcatggactgcaaggattcctagacatatggcccaggccgactgccgtcgcttggaagatcatcgccgtttatgctgcatttgaggcggcgctgcagctccttcttccaggaaagacagtcaagggccctatatctcctgctgggaatcagccagtgtataaggcaaacggaatggcagcatattttgtgaccttgatcacctatcttggcctttggtggtttgggatttttaaccccacggttgtttatgatcacttgggcgaaatatactccgcactcattgttggaagcttcatcttttgtattttcttgtacattaaaggtcatgtggcaccatcatctaccgactctggttcttcggggaatataataatcgacttctattggggtatggagctctatcctcggattggcaaggactttgatattaaagtcttcacaaattgcaggttcggaatgatgtcttgggcagttcttgctctaacctattgcataaagcagtacgaacagaatggaaaagttgctgattcaatgctcgtgaatacaatattgatgttagtgtatgtcaccaagttcttttggtgggaagccggctattggaacacaatggatattgcacacgatcgagctggcttctacatctgttggggatgcttggtatgggtcccatccatctatacctctcctggcatgtatctcgtcaatcatcctgttaacctgggaactcagctcgcactatatattttggtagcaggcattctgtgcatatatatcaattatgattgcgacagacagaggcaagaatttcgcagaacaaatggcaagtgctcagtatgggggaaggctccatcaaagatatcggcttcgtacactacaacatctggagagaacaaaactagcctcctcttgacttcaggatggtggggcttatcacgtcattttcattatgtgcccgagattcttggagcctttttctggactgtccctgcactatttaatcattttctgccttacttttatgtgatctttctcacaatcctattgtttgaccgggcaaaaagggacgacgatcggtgtcgatcaaagtatgggaagtactggaagctatattgtgagaaggttcgataccgaattattcctggtatttactgaggttcagcaagaactcctgtatggggaagatatggtcgggcgaaaggagtccacatggatcggctttggctcgttctcatgtacttcagaagatgtccctgtacttggttttataggagatgccagcggtagagctacttttcgtgtttcatgcatgcagcagcatttaacattgcgtttatctttgctactccaattcggaatgactttgtatcgaactcagagtatcggcactcagtaactgtagctttagtttgaaccggctgccctgaacgttgaggtttttcagactgcagtctatttctgcttgtatgttgacttgacgtagaaattgcgtggtgggacttatttcgaacggtgtgtgatttaa

SEQ ID NO: 47 - DNA, 1568 bp, Eucaluptus grandis
gctctctctctctctctctactctttctctctctaactctccgtccgccattgaagcttctcctccagcgcggaaccctagaggcatgaaggcgatgaggagcacgaagccgctgaagcccctcaagctcgcggtccccgctcccgacgccccgatcgcctccttcttgactgcgagtggcacgttccatgatggggatttgctattgaaccacaaaggtctgcggctcaagtctgaagaaaaggagtcttgtctttccaatggtaaggaacttgatcttgacttctcattggaagaccttgagactatcaaagtcataggaaagggaagtggtggtgtggtacaacttgttcgccataaatgggttggaaaactatttgctctaaaggtcatccagatgaatatacaagaagagatccgtaaacagattgtacaagagctaaagataaatcaagcttctcaatgtccacatgtcgtgatttgctaccactcgttctaccacaatggagctttctccttggtgttagagtacatggaccgtggatccctggctgatgtgatcagacaagttaagactattctagaaccatatttagcagtggtctgtaagcaggtcttacaaggtcttgtttatttgcacaatgagagacatgtaatacacagggatataaaaccatccaatctgcttgtgaaccacagaggtgaagtcaagattacagattttggtgtcagtgctatgctagcgagctcaatgggtcaacgagatacatttgttggaacttacaattatatgtcgcctgagaggattagcgggagcacatatgactatagcagtgatatctggagtttgggcatggtagtacttgaatgtgctataggacgctttccttacatgcaatctgaagatcagcaaagctggccaagcttttatgagcttttggaggcgatcgtcgaaagtccaccaccttctgctccagcagatcagttttccccagagttctgctcatttgtatcttcctgcatacaaaaggaccctcaacaaagatcttcgtctttggaccttttgagtcatgctttcataaaaaagtttgaagacaaagatatcgatcttgggattctcgtaggtagcttggaacctcccgtaagttttccgagatgctaagctgtgggtgcttatggggtaaaatcctcttactcatatgtatccttcctgcgcgtggttgaggattcgcatagagtgacttcgcttgagcaattgagcaaatgatgatagaagtctcttacttatagaaagagcagcatgccaaggttctgtactgagaaaattctgccttctacttaatcctaccagcttaagtgagcttacccgagatgtacttgttttggctccataaccttaaagagctgactcctgaaaaaacaagaaaacaagaagacaggcatctataatccatgcttagcctttataatccatcttcttaaacattttctgctcatgtatgcgagaagaaaggcagatgcatcaagccttttctgatgctgcccttgaacaattcccaaaaaaaaaa

SEQ ID NO: 48 - DNA, 2205 bp, Eucaluptus grandis
gaagaaggggccgggctcgagcccagagagagagagagagagagggcccacggagggcccacggagacgctcccgcgcgaggagggctttctgtcgcgctgcaggaggaaacggacagcgaacgctgcttcgctcccaatctttcaatttgtttgaacttttgagttgaaagggccgaaaggcgaatctcaatggcttggcttccatcacttccctgatttcttccctccatttccacccccactctccctccacccaccattccgagcgcaccagccgcgtccgaccaatcttgggttgctctcgtttctacccaacaaggtttccttgggatggattcaaccacacacagtttccagcgtcggccactctcgataaaactctggccgcctagtcaaagtactaggattatgcttgtggagcgtatgacaaaaaatctaatagctccatctgtattgtctagaaagtatggccttctgagtaaggaagaggccgaggaggatgccaagcgcattgaagagagcgcatttgctatcgccaatcaacacatggagaaggagccagatggtgatgggagttctgcagtacaagtttatgctacacagtcaagtaaacttatgctggaagtcatcaaaagaggcccaaggatgaaggtggatggcgaggccattttacctgcaaaagctattgctgcaagtgaaactgtctttgacatctctggaggtcgacgggcctttattgatgcggaagaagctgaggagcttcttaaaccattgaaggcaccagggaacttctacaagaaaatatgtttcagcaacagaagctttggcttagatgctgcccgagttgctgaaccttttctagtatctgtcaaggataaattgacagatgttgatctgtcagattttgttgcaggaagaccggaagccgaagctcttgaagtgatgaatattttttcttcagcccttgaaggttgcaacttgaggagtctggacctatccaacaatgcattgggagaaaagggtgtcagggcatttggagcacttctaaagtctcaaaataatctcgaggaactttatttgatgaatgatggtatctctgaggaagctgctctggcagtttgtgagttacttccttctactgagaagcttaggatccttcacttccataataacatgactggagatgagggagcgcttgccatttctgagattgtgaagcattctccggtgttggaggactttcgatgttcttctacgagggtaggctcagatggtggagtttctctgtgtgatgcacttagcgcatgttcccggatcaagaagcttgatctgcgggataacatgtttggtgtcgaatctggagttgctttgagcaaggctatcccttcatttgctgacctaacagaggtgtattttagttatctaaacttggaggatgagggcacagaagctcttgccattgctctcaaggaatctgcaccttcccttgaagttttggaaatggcagggaatgacattactgcaaaagctggtgctgttttagcagcctgtattgcagcaaagcagtttttgaccaagttaaatctgtctgagaatgaattgaaggatgaaggtgcaatattgatcggtaaggctttggaagagggccatggacagttggttgaagttgatttgagcacaaactcgattagaagggttggagcaagagtcctagcccaggctgttgtgcagaaacctggatttaaaatgctgaatataaatgctaatttcatttcggaggaagggcttgatgaggtaaaggatatattcaaaacttctcctaatatgcttggtccacttgatgagaatgaccctgagggtgaagattttgatgaggaggctgatgaggaaggcgctggtcacgaggatgaattggaagccaagctcaaggatcttgaaataaagcatgaggagtagtttggttgattctctgattgtttgattgagagagtttttagtaattttaaaactggttcagctctatttgcaatgtctagttgcttaattttaggttagttaggtgatgttcttgtcaaatctgtcattgcatgtgaagttcagaaacatgtaagatgatgatttttcttgctggcaagtttagcagatcatcatagcaaagctccatctgaagggtatttgataaggttacttgggaaaaaaaaaa

SEQ ID NO: 49 - DNA, 1306 bp, Eucaluptus grandis
ctctcctggttcaaaaacctagagagagaaagaagagagagagagagagagacggagaccgcaggaaattcatcgacgagagccgctcgtctccgatccgccgccgcgcgatcgccgatcgatccggccggagccgtgcggagatcggtagggtagattgccgaatcggggctggacctcgcgacccgcgatcgggattcggcacggaggtcctgcgcgcgatcggatctggtgggatcgatttcgaagggcgtagaaggagaagaagcaggaggaggaggaggaggaggagaaggaggagaatggtgaagctcacgatgatcgcccgcgtcaccgacggcctcccgctcgcggaggggctcgacgacggccgcgacgtgaaggacgccgagttctacaagcagcaagtcaaggcgctgttcaagaacctctccaagggccagaacgagccctccagaatgtcggtcgaaaccggcccttactacttccactacatcattgaagggcgcgtctgttacttgaccatgtgcgatcgatcttaccccaagaagctcgcgttccagtacctggaggacctcaagaatgaattcgggcgcgtgaatggggcgcagatcgaaaccgcggctcggccgtacgccttcatcaaattcgatacgtttatacagaaaacaaagaaactttatcaggacactcgtacccagaggaacatttcgaagttgaatgatgaactctatgaggtccaccagattatgacccgcaatgtccaagaggtacttggcgttggcgaaaaattggaccaggtcagtgaaatgtctagtcggttaacatcagaatctcgcatatatgccgacaaggccagagacttgaatcgacaggcactaattcgaaaatgggccccagttgccattgttctgggagtggtcttccttctcttctgggtcaaatcaaagatatggtgatgtgactgccttgcctgtacttctgttctactgcagtgggctgctgggttgctgagagattcattctcaacgattttaaatggggcacgggattttcacagagaatcatatgcgttcaaaagttagtgtagttcttctaattgcattttgtattggatgcttcattccttatgcagttgtggcaatagatttgccatgttaagtagtgaatagagaaccctcccttaagacaggagcaacatcaatatcttattgtcgacaaactagcagagtgttttccgtacaggaggctgcgtataacttttgttcatcaatacctataatcatctcttatagtaaaaaaaaaa

SEQ ID NO: 50 - DNA, 1860 bp, Eucaluptus grandis
cgctcctctctacaacaatctcgtgctcttttccggcaaactcctccttcgtctttgtccatctttcttgctatattataagttaccaagtcaaaaacccgacaagccttttttctttgaagacgatgagttacgtttcaagcaacagaaagccactgttgtctcggaaagcaaccaacgacggtcatgccgagaagtctccctatttcgatgggtggaaggcctacgacaaggacccatttcatcctacgcagaatcccagtggtgtcatccaaatgggtcttgcagaacatcagctctgtttcgacttggttcaagaatggctcgtcagcaacccagaagcctccatctgcactaagaaaggagtggacaaattcagggacattgccctctttcaggattatcatggcttgcccgcgttcagaaacgctgtggcgaagttcatggggagagtgaggggggacaaggtcaagtttgatcccgaccggattgtcatgagcgggggagccacaggagctcacgagatgatcacattctgcctggctgatcctggcgatgcgttcttggtgccaaccccttactatgcaggatttgatcgagatttgtgttggaggactgaagcacgacttctcccggtagtctgtcacagctctaacaatttcaaggtcaccaggaaggctttggaagaagcatacgcaaaagctgttgaggccaacatcagcgtaaaagggttgctcttaaccaatccatcaaacccactagggaccatcttagaccgagacacgttgagagaagccatgagcttcatcaacgagaagaacatccacctcatttgcgatgagatatatgctgctacagtctttcgtcagcctgatttcataagcatcgcagagataatcgaggaagatcaagaatacaatcgcaacctcgtgcatataatttatagcctctcaaaagatatgggtttccctggcttcagggttgggattgtgtattcatacaatgatgccgtggtggagtgcggccggaggatgtccagcttcggtctagtatcctcccaaactcagtacctaattgcatccatgttatcggacgatcagttcattgggaaattcctgttggagagtgcggagaggttagagacgaggcataagaatttcactgacggacttcatcaagtaggcatcaagtgcttgaacggcaatgcgggtctcttcttatggatggatttgagggagctcctgatggagagcaccgtagaggcagagacggctctgtggcggggcataattaacgaattcaagctcaatgtctcaccgggttcttcctttcactgctcagagccaggatggttcagagtttgcattgccaacatgaatgaggagaccatgaaggtcgctttagcacgaatccgagagtttgtgcggaggaatggcgataagctgaacaggaaggagaagtgccggcagagcgacctaaggctcagactctcgttccgaagaatggatgatgtgttgaggtcgccctgcattatgtcccctcactcgcccatccctcaatcaccactggttcgaaccagaacttgaagttggcaatcgcgtgattctacaaacgggcatttttcccattaaatccaaagctttccaaatgtaaaatagggaattgtattctttatttgcttgtaactgggtgcagtgcagaatgcatcctaatttttctgcaccccattttgttcattctttcatcaggcacggtattttaattttttccttctgtataatccctaagatggccctaagttccatcaggattgacattttcaacaatattcagactgtcgtgttgttttcaaaaaaaaaa

SEQ ID NO: 51 - DNA, 1995 bp, Eucaluptus grandis
ctttaagttcatcgtatccccttgtccttttgttcatggattccggaaactcacggaagagaaaatttgcaggaatcctttacctaattatcttgcggtgcatgcgtaggtatccaccagtttcatcaccacgcactttcagttctcccgatccccctttttaaaccccctctctctgctcacgcccttctttcaagatctgatcaagatttttatctatagattcttctttatttcaagataagcgattcgtttggtgtgtcttgcaagatctgaatggaccttggagcttgcaagaacctctcctctgtcgagccggttatgggcttgatccttggtgggttttggcggaggaattcaagaaagtcggcggttctttcttgagtggtgaaacaggggaattccttcctcctgttgttgccctctgaacgttcttgcgtctctctactttctgggaaaatagcgagtgggagagctgaaatcatgtgaggggagagaaaaggaaaaaaaggttttgaagaatctggcgcttggctgtttcgtgtttcgtggtgggtctgttctggaagaggagcccggagaaggtaaaggatagaattttatactcatcaagaaaggagatcagaggaaaaccgaaaaggggcagagagcataagcacagttcctcacagcaggagcggcaagggaatccatggcgactctggtcgagcccccggatggagttaggcagagagggaagcagtactactcaatgtggcggaccctgttcgaggtggacgccaagtacgtccccatcaagcccatcgggcgaggggcgtacggcgtggtgtgctcgtcaatcaaccgggagacacacgagaaggtcgccatcaagaagatccacaacgtgttcgaaaaccggatcgacgccctccggaccctgagggagctcaagctcctgcggcacatcaagcacgagaatgtgatcgccctcaaggacgtcatgctcccggtccacagcgctagcttcagggaggtgtacctggtttacgagctcatggacaccgacctgcaccagctcatcaagtccccgcagccgctgtccaacgagcattgcaggttcttcatttttcagttgctgaaagggctgaagtatctgcactcagccaacgttcttcaccgcgacctcaagcccggaaacctcctggtgaacgccaactgtgacctgaagatatgcgacttcggactcgcgcggaccaaccaaggcgacgggcagttcatgactgagtacgtggtcacgcgctggtaccgtgcccctgagctgctgctctcatgcgacaactatgggacctcaatcgacgtctggtccgtgggctgcatcttcgccgagatcctcgggcgcaagcccttgttccccgggacagagtgcctcaaccagctgaggctgatcatcgacacgctgggaagccagggggaggaggacatcgagttcatcgacaaccggaaggcccggaggtacatcaaggcgctgcccttctcgaggggcacccacttctcccagctgtacccgcaggccgatcccctggcggtggacctgctgcagcggatgctcgtgttcgacccgaggaagaggatcacagtgacggaggccctccaacatccgtacatggcaggcctgtacgacccgcggggcaacccgccggctcagtacccgatcaacctcgacattgacgatagcatggagcagcacatgattagggagatgatgtggaacgaaatccttcactaccatcctcatcagtatgcttccctccatggataaaatagcggaatccttcaccatcgacatgccagagcaagaattttctatcctctgttccctgaattttcccctgaaactttcttgttggttcctgcattgagagagacctaattgcttgatgtcctgtaatttgtaaaaagttgcaatggccacaccaactaagatagcacattgcaatttctttaaaaaaaaaa

SEQ ID NO: 52 - DNA, 931 bp, Eucaluptus grandis
ctcgttgcttcgcggtcgagggagggcgggggggggatcgaccggatggggcagcaatcgctgatctacagcttcgtggcccggggccccgtcctgctggccgagtacaccgagttcagcggcaacttcaccagcgtcgcctcccagtgcctccagaagctccctgccaccagcaacaagttcacctacaactgcgacggccacaccttcaactacctcgtcgacgatggcctcacttactgtgtggttgcagttgagtctgttgggcgccagattccaatggctttccttgagcggatcaaggaggactttactcacagatacgacgcaggaaaagctgcaacagcatctgctaatagcttgaacagggagtttgggcctaaactcaaggagcacatgcaatattgtgttgatcatccggaagagatcagcaaacttgctaaggtgaaagctcaggtatcagaagtgaagggagtaatgatggaaaatattgagaaggttcttgatcgtggtgaaaaaatcgaacttctggttgataagacagacaatcttcgttctcaggctcaagacttcaggcagcagggaaccaaaatgcgaagaaaaatgtggctgcagaacatgaaaataaagctgatagttctgggcattattattgctttgattctggtcattgttttatctgtttgtcatggcttcaattgtggtcataaatagtggagtggtgctgctaataggttcttatgaacctgtcttgaaggtattttgcctgtaagttttctttcctcttttgttctttacatggtccttcattatactatagcctatagaagaaatacatttgcatgtatagtttgtattcttggacaagttctataatcatcgcgccccggattgtaatgtcagcgacctatgagtgctgataaaaaaaaaa

SEQ ID NO: 53 - DNA, 2862 bp, Eucaluptus grandis
agctattatcctttgcttccaagtgcttctccgtcgtacttggcgtgtataagtcgaatctcgcctgaatttgctgatgtttctctagatccttagattaaggtttgatctgtgtatatgctgtgtcgttgcctgagaatggttctgggtttgatgatggcgatattggtcgaggcggctgtgctgtgagattctttgtcgagatcgccggttgagcttttcgggagtttgtgtattgtttggaggtagttttgcgagaaatgtaggacattgatgtcgtcgttgagtttaataacttagttctgttcagtttcttggttttccgtggcagaacggcgagtgtggaaatggctgatgtagcgggtcgtcgttgagtttattaacttagttctgttcagtttcttggttttccgtggcagaacggcgagtgtggaaatggctgatgtagcgggtctgactgaagcggcggggtccagattcagttcgctcgagttgattgggagaggatcttttggagatgtctataaagcatttgataaggagctcaacaaagaagttgctatcaaagttattgatctggaggagtcagaggatgaaattgaagacattcagaaggaaatttctgttctatcacaatgtcgatctccatatattacggaatattatggttcctatctccaccagaccaagctatggataataatggagtacatggccggtggctccgttgctgatctacttcaatcaggtccacctcttgatgagatgtccatagcctgtattttacgtgacttgctgcatgcaatcgaatatttgcacactgaagggaaaattcacagggatattaaagcggccaacattttattgagcgagaacggtgatgttaaggttgcagattttggtgtttctgctcaattaactagaactatatcaaggagaaagacatttgtcggaaccccattctggatggctccggaggtaattcagaattcggatgggtacaacgagaaggcagatatctggtctctagggatcactgcgattgagatggcaaaaggtgaacctccgcttgcagatcttcacccaatgagagttctttttatcatacctcgagaaaatcccccacagctggatgagcatttttctcgttccattaaagaatttgtttccctgtgcctgaagaaagtaccggcagagcggcccagtgccaaggaacttctgaagcaccgtttcataagaaatgccaggaagagtccaaggcttctagagcgaataagagagcgtccaaaatatccgacagtggaagatggagaaacacctatgattggtaaaggtgtagtggagggatcagacactgtgaagattagaagagacataaaaggagaagaaacagtaagagccagtaatcaagggcgaggagggaagaatactggatgggatttcagcattggtggagtgcagggaacagggactgttaggaccaatctattgccacctcaagtcagagagaggaaatcagagaattcccacaatcaggctacccctagaagagtggcggatggtggtaactcatggttgtctgcatctggaaattcacctcaggctgcagaaatatcacttcggaaagatgctagagatttgcattataataatcaccacgatgacgaagattcatctttgagcggatcgggtacggtcgtggtacgaactcctagagaatctcaaccatcacccttgcttcgcgatcaaagcactctgtctagcagctcgtacagttctgttgaagatgcttctacaacaggaactgtagttttccgcggtcaacatgatgagtctgattctcctcggacaccaaaatcgagactcgggattcaggagagaagttccagtgcttcactggaagacagtgcagcaaaccttgcagaggctaaggcggctatgcaaggcgcttttaaaagaggaaatgcaagagaaaagagatctgtactaggtaagtttaatgacgggcaggaaaatgggaatagagaacaacttacaaaaagccctgattcgtcgaggaattcctatgagtattttgatgctcataaagttctcccgaggtcccgccaagcaagcgatgatgaggacattgcaaaaattttatcttcatctgctccattatcggttctgctcatcccttccttgaaagagacaactggtgatgattctgatgggccagttgtccatgctgtttcaacctcactcactaacttagagcgcatgaagccaggatcatgtgaggttcttataagcaagttgctacagagattggcaagttcaaaagaatcctcgttgaaagacttgcaggatctggcaactcacaccttttccaagggcaagatatccccagaaaagtcgggaaatgcgaacactgaagctgataatcgcaagaaacaacagaacaaagaattcaattctaatgctaatttaagcccactagcaagatttttgctctcaagatggcaaggccaagtatcccgagatcttaacccaacttgagagagaagaagagaatagtatctatttgtttgtattgtgcttcgtgtcgatgcatttattctgattcactgtacatagaaatgatagtgtatttattagcaaccaacctttgtctgagtaaattgcctctgatggtaagagttgctgcgcgactaggaggtttgttgttggtgcactaacaatgtaaaaaaagacaaaatggaccatcattcttatttatcgatggttgaattttggcttttattttctcgccagagctttcccgccgttttcgatcaatacaaagaagagcagtaccatggatttgacagagtaaaaaaaaaa

SEQ ID NO: 54 - DNA, 996 bp, Eucaluptus grandis
agaaaatacagaaatctcagcacgatccccatctcctccttcgccaaagtcgttgggaacttccccccttctccctctcgctccgtccacgaagcaagcaagctctccgcgaagatcccttccttgttgttaccaaattggttgaagcttcttgtgggttgctggacctgcagattttggttaataaatgagtcagaagggccttatatatagctttgtggcgaaagggactgttgttctggccgagcacacgcaattttcgggaaactttagtactattgctgtgcagtgcttgcagaagctgccttctaatagcagcaagtacacatactcctgcgatgggcacacatttaacttcctaacggatagtggatttgttttcctggttgttgctgatgagtccgtcggaagaagtgtgcctttcgtgtttcttgagcgagtgaaggatgactttatgcagcattatagtgccagcattgcaagtggcgacccacatccacttgcagatgatgatgaggatgacgatttgtttcaagatcgttttagcattgcatacaaccttgaccgagagtttgggccaagacttaaggagcatatgcagtactgcatgagccatccagaggagatgagtaagctatccaaattgaaggctcagatatcagaggtcaaagggattatggttgataatattgaaaaggtgttggaccgtggggagagaattgaacttctggttgacaaaacagagaacctacaattccaggccgacattttccaaaggcaaggaaggcaactgcgtaggaagatgtggtttcagaatctccaaatgaaggttgtggtggctggagcagttgtcatagtaatattcttgctgtggcttatagcaaagtggggaagtaaataaaacttgttctcagggtcgacgcggccaaggtacaatatgattttgtatctggatatgtttgttggtatgtggagctagcctaccacttaggattt

SEQ ID NO: 55 - DNA, 994 bp, Eucaluptus grandis
cggcactcgccatcggagcagctggtgggattgctcgcggctttctgctcatggaaggagaagaagagcagaagccggcggcgacgaagcggaggaaaccgagatcgggagcgccttcttccgccccgatcaacaatctcgatgacgggtgcctcatgcacatcttcagcttcctttctcctattccagatcgttataacaccgccctcgtttgccacagatggtgttacctggcatgtcaccctcggctgtggctacgagtagaccggtctgtaaaggattcatcagagccaggagttttccccaatattgagttggctgtctctgctgcaagacctggagatactattctgattgcagcagggggaagtcatgttgcctctaatattcagataaagaaaccactttgcctgattggtggaggtgaacttccagacgagacaatgcttctctgttcacgaggttcagacagtgccctggagttcctttccacctgcaaactgtcgaatctaactgtgaaagcggagcttggatgctgtctgcttcataggagcggaaggctgattatcgacggttgtattctccaatgcgagacagaccctttagactacctctcgtgcccaattgtgagcacagctacaggcagcaaggtcgtttcctctcctaatgggtgtcatggcgatggtgtttcggtctctcggacacgaattgaaggtggtgccaaagccgtattgactagtggggacctggcattgcagcgtgttcgggttatatgcgctcgtacttctatgttcttctggttcgacgtcgagtgtccctcttgactcgatatctttgtgctgttgtctgtagtatatatcagtaccagttagttttactttttaaagatgttaatgaatattgctgtgatggtgtggatactgtggaattttcatcgtatcctgtcatccaaatccttattttcttttgagataattaaccaataaaaaaaaaa

SEQ ID NO: 56 - DNA, 2252 bp, Eucaluptus grandis
cgccctcgatcttgcaagaccaaaaaaacacagtgagtcctccgtgcgcacccgaagaaccacaggataagataagccgcctgaatcttctcttctcctcccccttcaaccgcccacctccctcgccgcctccgcctccgccggcgatgggccagtcgtcgtcctcgacggcccccgcgctcggcggccgcggcgccgaccccgaccccgaccccgaccccgacgacggccactcggcggccaagtcgaaggccgtgatctggccggtgctcggggaggccgccgccgaggagtgcgccgcccccgatctctccctctccatctccgatctccccgacgagtgcctggcctgcgtcttccagtacctaggctccggcgaccgggcccggtgctccctcgtgtgccgccgctggctcgcggtcgagggccagagccgccagaggctcgccctccacgcccagtcggagctgctggaagcggtcccggcgctgttcgcgcggttcgactcggtctcgaagctcgcgctcaagtgcgaccgcaaggcgctgagcatcggcgacgacgcgctcgtgctgatctcgctcaagtgcaggaacctcacgcgcctcaagctgcggggctgccgcgcgctcacggacacggggatcgcggtcttcacgagcaattgccgggggctgaggaagctctcgtgcggatcctgtgcgttcggagccaaaggcttgaacgccgtgattgatcactgcgcctccctcgaagagttatctgtgaagcggctccggagtcccactgaaggtgctgcggcggagccgattgggcctggtgcggctgccgcctccctcaaaacgatttgcttgaaggagctttacaacggacagggcttcggtccgctgatcatcggctcgaagaatttgaggacgttgaagctggtgaaatgttacggagattgggacacggtgctccaagttatggtggagagggtcgcaaaattagtggagatccatctggagaggatccaggtaagcgattttggcattgcctcgctatctaattgctcggatctcgagatactgcatctgttaaagacaccgcactgcacgaacttagggctcatatcggttgccgaacgttgtacgttgttgaggaagctccatattgatggattgaagctgaaccgcattggcgacgatggtttgattgctgtcgcaaagcgttgccctaatttgcgagaacttgttcttatcggcgtcaatcctacggagttgagcttggatttgctaggatctaactgcctcacgttggagagactggcgttttgcggtagcgatacggttggagacgctgagattatgtgcatcgcggctaggtgtgtggcgctcaagaagctttgcatcaagaattgcccagtttcggacgaaggaatgaaggcattagcctctggttgccctaacttggtgaaactgaaggttaagaagtgtggtggagtgacttctgagggtgcagcttggttaagaatgagaaggggatcgcttgcgttgaatttggactccagtgaccaagaacagatagacgcattcgccagtgatggtggaggagaagaaaatcatgtggagtttcctcccgtacctagccaaacagccggcgctaatattgcatcatcgagcggcaccagtcggtcatcttcctttaaatcgagattgggcagtttgagaggaaagagtttgatggcatgcacgttcagaagatggtcaagtggcagtaaagattcctaaaagccaagatcttaggggaatctctgaacagccagggtaaaccaatgactgtccctcggcgcatcaaatttgaattgttgactttatgggtctgaaggtttcgaactttgatcttcagatgatcagcttcgtgccatcaccgattgttgtcctaacatgcccaaacctgttttaattggtgtcggtcctaaaaaaaatcgtgcttgagtttgctggaattaaattccctgagtttagagtggtttttagcaatcaatggttagggatactattcccttcgctaaatgtacagctttagagaaactttgttcggagaatttccccatttcgattaggggtagaagccctagtcggctgttgcccgaacttgctgatggcgatgctcagaaggtatgtactgtttgtggagtgactagtgagatgcagtttgtgaggaaagctcgtgtttgaaattgatgctttaaattggagggaaaaaaaaaa

SEQ ID NO: 57 - DNA, 843 bp, Eucaluptus grandis
cgtgaacgtcttgcgctcggttcttgagctcgttcttgagagctgaacggagacgatgggcgaggaatcgttcatatacagcttcgtggcgagagggacgatgatcttggcggagtacacggagttcacgggcaacttcccggccatagccgctcagtgcctccagaaactcccttcctccaacaacaagttcacctactcctgcgatcaccacaccttcaatttcctcctcgaagatggctacgcttattgtgttgtcgccaaagaatcagtggccaagcaaatctccattgcatttttggagcgtgtaaaagttgactttaagaaaagatatggtggcggcaaagcagatacagctgttgccaaaagtctgaataaggagttcgggccaattatgaaggagcacatgaagtacattattgaacatgctgaagagatcgataagctcataaaagtgaaggctcaagtttcagaagttaaaagcataatgctggagaatattgacaaggcgatcgatagaggggagaacctgaccattctagccgacaaaacagagaatctgcgtgatcaggctcaagcatacaagaaacaagggacacaaatccggcgaaagatgtggtaccagaacatgaaaatcaagctggtcgtgtttggtatcttattatttctgatccttgtaatttggctttcaatttgtcatggatttgattgctccaactagtatattatcatcacatggagaaaggttcagcttcaattagagagagaagagagagagagatcttgtaactatactggcggagaaatgtatcatttgttgttacttgggactgaaaaaaaaaa

SEQ ID NO: 58 - DNA, 1059 bp, Eucaluptus grandis
gcatcaaaattgacatcgcctctcctctaatgcctcggtcgtctctcttctcttccatttcgccctcgttctccacggccgttccaatccgacctcgccggaatctttgaatttccttttattgtttccgatcgaggggggtttcggccggcgggaggagctgcgaagatttccctcgcgcggcggatggcgggcgggtacagggccgacgacgattacgattacctgttcaaggtggtgctgatcggggactccggcgtcggcaagtccaatctgctgtccagattcacgcgcaacgagttcagcttggagtccaagtccacgatcggcgtcgaattcgccactcgcagcatccgcgtcgatgacaaggtcgtgaaggcccagatttgggacaccgccggccaagagaggtaccgagcaatcactagtgcatattaccgaggtgctgttggcgcattgcttgtctatgatgtaactcgtcatgtcacattcgagaacgtggagagatggttgaaggagctgcgggatcacaccgactctaacattgttataatgcttgtggggaataaggctgatttgcgacatttacgtgctgtttctactgaagatgccacggcatttgcggaaaaggaaaataccttctttatggagacctctgcgctcgagtctatgaacgttgagaatgcgttcactgaagtgctcacccaaatacatcgagtagtcagtaggaaagcccttgaggctgggaatgaccctggagctcttcctaaaggacaaaccattaacgttggatcaaaggatgatgtctcagaagttaaaaaggtcggttgctgctcttcttgaggatttacccgtcaaacatttgaaggaaatgaaattttctccagtagtctcatgtgtccagatgctttagtttctctactctctttggttttcagttttctacttcatacttgttgtactctcacttgtataattctttccttttctctggctcttcccttcttttttgtcttggggttgtgattgctctaaattattgggacaagctcgaaaatt

SEQ ID NO: 59 - DNA, 1602 bp, Eucaluptus grandis
gcatctcccacccaacccctactctctctctctctctctatctctatatcgtcctgtcaagaagaaggaagaagacgaagaaggaaggtgaacaagaagcaagaagaagatgcagcagtagaaaggtgagatctcgatctcgcaccgatgctctcgaatcgaacctgttcctccccgatccccccgcatcgattcgcctgaaccacaaaagagttcgcatccttttccctccttcgaggcgtagagcagttagggccttgagcattcatggcggaactcgcgggcgatctgcccggcgagctggtgaccgagatcctggaccgcctcccggtcgagtcgctgctccggtgccgctccgtctccaagcggtggcgcggcatcatcgacagccgggagttcgtccgctcccacctcgcccgctccttcgagtccaccgccaacctcaccctcttcttccgccactcctccagcctctactgcatcgacctcacctccctcctccgccacggcggcgtcgccgagatgaactacccgctcatgtgctacagcgaccagatccgcgtcctcggctcctgcaacggcctgctctgcatctccaacgccgccgacgacgtcgtcgtttggaaccccgccacgcggaagcacaagttcctgccgtactccgccgtcgaggtgcggcgctcctcggttttctccgtctgcgtctacgggttcgggtacgacgagaggcgagacgattacgtgctgctcaggctcgtccagctcgtgacggagccgatcgagtcggaagttagtatctacagcttgaaggataacgcttggaggcggctcaaggacatgccgtactccctcgtttatccccgcaagatgggggttttcgtgtgcggccatctgcactggataatgactcgggagctggtgtcggattcggcgaatctgctggtggctttcgattttcgaattgaggattttaaggtggtggaccagcctgaaggtatcgataataagcttgacatggatttgtccgtcctgggagggtgtctctgccttagcattaacgggaaccacatgggtgtccatgtgtggattatgaaagagtatggattgagagattcatggactaagttgttctcgataccgcaatctgaagttgccagacctcttgggtttgtccggccgttggcttacgccagcaatggtcgtcaagttttggtaagacaggacagtaagaatctcattttgtatgatctagagactaagggcatggagagggttgatataaatggcatgccaaattcctttgaagcagaaatttgtttgagaacccttgtttcggtcgatgattatggaggatacaccaagaagaagcagcaagaagcggaagagattgagaataggaccaagagggatgacttcctctcggtgggcttcaagcttgttctctaatcgagacatagttgtgcaaggggggtgtcacaaactactcagcgaaggaaatgcagtaggagaagttaagttttttgcctcagtatttagattcatggctcaactttcgacaatatggaccaatgtatcattgggaaaggtttggcaaaaaaaaaa

SEQ ID NO: 60 - DNA, 1565 bp, Eucaluptus grandis
cttcttcttcttcttcttctttctcctctctatggcggacaccgcaactcgagcgattcctccgagaatggagttctccgacgaggctgcggccggcggagctgcggcgccggcggctgcggcggcggcggcggaggaggaggaggaggaagaggaggcgccgtcgccggcggcggagatcagcgaggtcgagaagagcaagatcggcatcatgcgggccgtcgtggagcgggacgacccttccgccaaggatgtcgatgattttatgatacggaggtttctgcgagctcgggatctagatatagagaaggcttccaagctatttctgaagtacctgagctggagacggtctttcgtccccaatggggtcatatcggcatcagaagttccaaataaccttgctcagcggaagttgtttatgcaaggtcttgacaaaaagggacggcctataatagttgtgtacgggggtagacataatccttccaaaggaagtctcgaggagttcaagcgtatgatacttctctgattcttccggattttcttctaatcaatatgaatttatcgcttcatgcaagacttaccatcatcatattattgaaaagaaatttaggcagaaaaatactgaatttggctaaagttgagttgttttttactgtggcgaaggttttgtggtctacactcttgacaaaatatgttccaggtaactcttctccttattaagactctgcacatcacggaaatctaaaaacattgcaaactgaggattcttccaaaaatgaaatccttcagaagcattctggttaaggtgtctatcttgtgaggcacaaaaattgcacgtgtcacctaattgcatgattggaaaagaatggccatattagttgcaaatgaagcccttgaagactatatctagagccaccctcctcaatgggaagtatcggaaagtttttacctggtcccttattggtttctcaattcccagtttcttaagaactgtgatcaacccaagtctttcttttgaattcgctatccagtgttggtcaaattttagccaataatttaagttgtttcttgggtgttgatctttcagaatgcctggagggcaggagaagtttatgggcatagcagatctcgaaggatggggatacaaaagcagcgacattcgtggatacttagcagcattgtcaatcttgcaggactgctatccggagaggctgggcaagctctttcttattcatgtgccttacatatttatgactgcatggaagatggtttacccattcatcgaccctaagacgaaaaagaagattgtttttgtcgataacaaaaaactgagaactactctgctcggggacatcgatgaaagccagctcccggatgtatatggaggcaggttgccactagttgccattcaagacagctaaattctgctcaaattacaagaattttctcctcatttcttttctggccgtgggtctatattgtagaatataatgaagatataatttgataaaatgcggaacaacagccaaatatttcatggctgaactctcttgataaaaaaaaaa

SEQ ID NO: 61 - DNA, 2330 bp, Eucaluptus grandis
agaacaagaccccgtccctcactactactgcacgcgcgacgcgacgggagatatggctgctcggctcttttcaagcctcctctctcgctcctcctccgccgcctcctcctcctcgtcgtcttcttctgctcgtgctctgctttctcgagcgagaaaaccgctactgggaagagaaatcaagagctacagcacagcagctgctatcgaggaaccgataaatccaggcgtcactgtgaaccatactcagcttttcataaatgggcagtatgtggactcagcatcaggaaaaacttttccgacctttgaccccaggaccggagaagtgattgctcatgttgctgaaggcgaggctgaagatataaaccgagctgtagctgctgctcgcaaggcattcgatgagggaccatggcctagaatgactgcttatgaaagggcaaatgtactatttcgctttgccgatttgcttgaaaagcataatgatgagattgcagcactcgagacttgggataatgggaagccatatgaacaggctgccaaaattgagcttccaatgatcgtccgtcaaattcgatattatgcaggttgggctgataagattcacggtctcacagttccagctgacgggcagtatcatgtccaaaccttgcatgagccaattggagttgcaggtcagattattccgtggaatttccctcttctgatgtatgcttggaaggtgggacctgccttagccacaggcaacaccgttgtactgaagacggcagagcagacaccactttctgctttatatgcaaccaagctcttgcatgaggctggtctcccccctggagtgttgaatgtggtttctggttttggtccaactgcaggcgcagctctttccagtcatatggatgttgataagcttgctttcacaggatcaaccgacacagggaaaatcgtacttgagttggcagcaaaaagcaatcttaagccagtgactttggagcttggagggaaatccccttttattgtatgtgaggatgctgatgttgacaaggctgttgagctagcccattttgctcttttcttcaatcagggtcaatgctgctgtgctggatctcgtacatatgtacatgaaagcatatatgaagaatttgtagaaaaggcaaaggcacgggcaacagtgcgtagtgtgggtgatccgttcaaaagtggcatcgaacaaggtcctcaggtaagttagccgattctcctgtatgaggaaatttgaatggataagattgatatcttgcgaatggaagtaaactcctgctcttatgactcttttgtcaaatgtaattgacaaatttgatatttttgtcgatttcacataaatttactggatggaaattgaaatgcaactgaaataaatccttgataaatggagctagtcgtttgactagtacctgtatgtagatctaatggaagctacagagttctgagcgttctttatctttacctcacatcagatagactcggagcagtttcagaagattttgaggtacataagatctggagtagaaggtggagcaactcttgaaacaggaggagaaagatttggaaccaagggacactacattcagccaactgtattctcaaatgttaaggacgatatgttgatcgctaaggacgagatttttggtcccgtgcagaccattttgaaattcaagtgagtataagaccatctcctcaagctcattactagagcggctttccggttaggatgcatggtacgattgtctgttgacatggtgacatctttgtcatgtttaattgcagggacctcaaggaggtgattcaaagggcaaacaactcacgctacgggctggcagctggagtcttcacccagaacatagacacggcgaataccttgacccgcgctttaaaagttggaacagtttgggttaactgttttgatgtctttgatgcggctattccatttggcgggtacaaaatgagtggccatggaagggaaaagggcgtgtactctctgagcaattacttgcaggtcaaagctgtggtcacttctttgaagaatccagcatggctctaagctgaagtttgctttcatctttggatttttcgacccttgatattttttaataataagggaagtaacagatactggagttcaaattattatcgtgacagttgtgatgggagttttgaggcggtgacgacgacgattgtaggacgctggtgaaattgcttctgtagcaaacagtgccgtgaagaattcactttttgagtgttcacgatcaaattgtgctactatacattattgatgttacttttgccatcttccaggcttg

SEQ ID NO: 62 - DNA, 1463 bp, Eucaluptus grandis
gcatgagttcctcctcctcctccggcggcggcggcggcggcgcgaagctccctcacgacgtcgccgtcgagatcctgaagcggttgccggcgagatccctcctccgatttaggtgcgtctgccgatcgtggcgttccgccatcgacgaccctcgtttcgtggccctccactggagccactccgccctccacgcctccagtcggcatctcgcgtgtctagactgcggcgacgacgccgtccagaaccggtgctctctgttccccaacgcccctctcgccctgcctcctcccccgtcgcaaatcgaaatcccgttcgttgctcctcccaaccgttacgccctcgtcggttcgtgtaacggtttgatctgcgtctcggagagttccagtgacggcactgagcgggcgctgtatttttggaatctattcaccaggaagcataaggcggttcggctcccccgtccggagcggatgccacccttctccgtggggggcgctcatgtagttctggggttttgtttcgatgcgaagtctaatgactatcgtgttgtcaggattatccgatacctaggtattcgccgtcgacgcttccgcaataagaagcctcgagtcgaggtttattcgttccgtacagattcatggaagaccttggaatgtgaggttcctcttctctgtgacagtgcggtcttcttgaatgggaacctgcactggtattctttcaatggggagggggatggatacggatccatagtcttgttcaatgtcgcagatgaggtgtttgatgaaatagctctgccggaagggatcagtccccattttgtgttgtccgtgacggtattgaatgaatcgctggctgtgttctttagtcatagggaggcttgtttcgtttgggttatgaaagactacggcgtgccagagtcttggagtaagctgtatactttcgaggttacggaaccggtaacaggatttgatggctttacatggaatggcgagcttcttatggaaataaattgtgaagaacgagtttcttggaatccgatcacagcacaactctcaattcttccattgtcggcgagatacaaattggtccccgttgtagagagcctcgttccaccttagatatgactcgattgctgctatatcgtcaggtgcaaggtgctggagctcttctttattaacaggaattctggtgattggcaatgcaagtacagctggctctaacaaaaatgggggagtggcaaaggacagcagaaagtgatgttgaagtttcttcggaatatagtttacgtggaaggcaagaaacaatctgcttcatggttaagctacttctcccttcgagcatgttcttagattgatcgatttgttacttaacatcaatttgaaggctatctagtttcaaaaggatacatgtcgtgcttatgattatctatataatgtaatgtgtgagatttgcttataaaaaaaaaa

SEQ ID NO: 63 - DNA, 2195 bp, Eucaluptus grandis
caagcgcactgcattgattttcgaacatcgccggacgagacacacacaattcgctctcattttcaaaatcgatctatccaaaaccctctttctgtctttaggccatttctcctctttgccatctcacagtctcactcgcctttcattcgacgctcgtcgctctctttccccgaacgtttgaagaaaacgcgacggtttttgaggttgtgttgtgatggatgctgcaccattgacttctcagcgccgaccattttcagtgaaactatggcccccgagcaaaaatactcgtgaaacacttgtagaacggatgacaaggaatctcacaagtgaatccattttcactaggaagtatggaagtttgagcccggaagaagctgaggaaaatgcaaaaagaattgaagatgaagcttttacaactgctaatcaacattatgaaaaagagcctgatggtgatggagggtctgcagtgcagctctatgctaaggaatgcagtaaacttatactggaagtcctcaaaaaaggcccaaaaggcaaggatgaaaagccgccaacttctgacagtgctaaggcccctagagagacattttttgatatttccaagggccagcgggccttcattgaagcagaggaggcagaagaacttctgagaccattgaaggagcctgaaaattctttcaccaaaatatgctttagcaatagaagctttggattaggagctgctcatgttgctgaacccattctgatttccctgaagcaacaattgaaggaggtagatttatctgatttcattgcaggaaggccagaaacagaagctcttgaagtcatgagcatattttcagctgccttggagggtagtgttttgaattctctaaatctttccaataatgctttgggtgaaaaaggcgtcagagcatttagcgcactcctgaaatcacagagtcaattggaggagctctatttaatgaatgatggaatttctgaagaagctgctcgtgcagtatgtgagttgatcccttccacagaaaaacttagagttcttcattttcacaataacatgacaggagatgaaggggcgattgctattgctgaggttgtgaaatgctcttcattaatggaggacttccgctgctcctccacaaggattggctctgatggaggtgttgccttatcagaagcacttgaaaattgcatccatctgaagaaacttgatttgagggacaatatgtttggtgtagatgctggagttgctttgagtaaagctctttccaagcacactaatttgactgaggtttacttgagttacctgaatttggaagatgagggggcaattgctatagccaatgttcttaaagagacagcctcatctcttacagttctagatatggctggcaatgacataacagcggaagcagctccaactttatctgcttgtatagctgcaaagaatcttctcaccaaattgaacttggctgagaatgagctcaaggatgaaggtgctattcagattggcaaagcattgcaagaaggccatgagcagttgacggaagttgatttgaacaccaactcgatcagaagggctggagctcgattcttggcccaggttgtggtgcagaagcctggtttcaagttgctcaacatcgatggaaatttcatttcggaagatgggattgatgaggtcaagagtatattcaagaaatcccctgaaatgctggcttccctagatgagaatgaccctgaaggaggtgatgaagatgaagaggacgaggaaggtgaagcggaaggtgaagctgatgaaggtgagctggagtcaaagttgaagaatcttgaagtaggtgaagagtaggatatgttctttctagtttaaggtaatttgaattggctgtccaagttagttcaggaacagctttaatagccaggaacatttttgctgaatttttagctcattacatcgtcgaggctcatgaaccatgagcaggataatcgtagctcctagagatgagcattttttttactcaggaggacgaccttggaggagctgttcgtagggtactcattttacagtgtaccgggtaatcttgtcgtatgaagggattaccagaacttccgttctagttactagctactagctactagctagtgaattgttttaatgcgctttcttctctcctagctgattttattcattaaaaaaaaaa

SEQ ID NO: 64 - DNA, 1314 bp, Eucaluptus grandis
gctctctctccctccctccttccctctgatggcactcgtccgcgaacgccggcagctcaacctccgcctcccgctgacggatctccccaaccgccgcccgctcttcccgccgcccctctccctccccctccctccctccgccgccgccgccgcctccgccaccgccgccgccggctccggcgccgccgcgacctccctgtccgacctcgagagcctcggcgtcctcggccacgggaacggcggcaccgtctacaaggtccgccaccggcgcacctccgccgtctacgccctcaaggtcgtccacgccggctgcgacgccaccgtccgccgccaggtcctccgcgagatggagatcctccgccgcacggactcgccgcacgtggtccggtgccacggcatcttcgagaagccgaacggcgacatcgcgatcctgatggagaacatggacgccggcagcctccagacgctcctggaggcctccgggaccttctcggagaagcaactcgccgccgtcgcccgccacgtgctgaacgggctccactacctccactccctcaagatcatccaccgcgacatcaagccgtcgaacctgctcgtgaactcggcgatggaggtcaagatcgccgacttcggggtgagcaagatcatgtgccggaccctcgacgcgtgcaactcctacgtcggcacgtgcgcgtacatgagccccgagcggttcgacccggacagctacggcggcaactacgacggctacgccggcgacatctggagcctggggctgacgctgctggagctctatctgggtcacttcccgctgttgggtcccggccagaggcccgactgggcgacgctgatgtgcgcgatctgcttcggggagccgccgaagtcgcccgacgggtcgtcggaggagttccggagcttcgtcgagtgctgcctgcagaaggagtcgagcaagcggtggtcggtggcggagctgctgaaccaccctttcatagccggcggtaaagatccggcgggatccttgtgaggtggaagcacgcgggtcgggttgaggcaaagtattttaccgctggaaaacccggaagtcgaggcgggcgcacgcagaacgggcccgcccgggacaaatcaagtacgggtcgggtcgagattcgcttcgcgatgagtttttgtacatatagggcggacttcgggtcgcaaattcgggcgctctctgtttcttttttctttttcaatgtcctctttaggatgcttcgggcagtgaaattgctgttcgagaactaatgaaggacccttcttgactagttcaaaaaaaaaaaa

SEQ ID NO: 65 - DNA, 1442 bp, Eucaluptus grandis
gcggaaaacccgaatcccgggaaaaagaaacaagcctcgagatcactgatcagagagagaaggagggagatggtgagcgcagcgcaggcggcgggcgggagcctgagcctgagcctgagcctgcgcgatcgcgagatcctgacctcggtgaactcggtggcgtcgagcttctcgctcctcggctcgggcttcatcgtcctctgctacctcctcttcaaggagctccgcaagttctccttcaagctcgtcttctacctcgccctctccgatatgctttgcagtttcttcaacataattggtgatccatccataggattcttctgttatgctcagggttataccacccacttcttttgtgtggcatcctttctttggacaacagtgattgcatttactcttcaccggactgtcgttagacacaagactgatgttgaagatttggaggctatgtttcacttgtatgtatggggcacatccgtggttatgaccatcatacgctctattggcaatgatcacagacatttgggtgcatggtgctggtcacaaacagggcgcacaggaaaggcagttcacttcattacgttttatgcgccactctggggagcaatcctttataacggtttttcatactttcaagtgatacgcatgttaaacaatgccacacgtatggccgttggcatgtcagatcgagcataccacttagatgcaagacctgatatgaaggctttgaacaggtggggatactacccgctcattctgataggatcatggacttttggtacaatcaatcgcatacatgacttcattgaacctggacataagattttttggctgtctcttcttgatgttggcactgctgctctgatgggtctgttcaactcaatagcatatggcctgaattcttccgtgcgacgggcgattcgcgagagattggatctagtaacgtggccggagacgattaggccatggttgcctaacagttcaaggatcagacaccaacagcaagagagtgaactagtgtcactgaaaagccaagatccgcactgacgattccaagattatgcccatcttcttcgacgagtggtcgagtatagccatggagctactggttttgaaaccctcatcagactgatccaaagttctggtagatgctcacgggatggaccttcttctgtcattttaatgaaacagccggtaatcttttcgcgacaaaggggtagcgttgcccatctgcaactggtagctgcaatcttgtacattaggaaggtaaaaagccctttttgcgattgtgattccttcctccgctggggactcgggtgccggctccccattttgtaggtcgaattgtacaacaatctctcgtctccctaatatccgttacgatcatattctttcgacaatagactgatccctgactgctttacgttgtttcaaaaaaaaaa

SEQ ID NO: 66 - DNA, 1937 bp, Eucaluptus grandis
gctcatatcgaacctgttccttctggatcatgtgaatcgattgaccaaaagaggagcgttttctcatcgtcttcctctttgtcgcagtttgtctcgagctgtaaggagattcgccacaatgtagccgtcacggctcgtctcgaactgtaaggaggcgagattcggaagtactctgggaaatggcgggcctttcggacgatctgatcaccaagatactggaccgattcccgaaggaatcgctgatccccttcaggtgcgtgtccaaacagtggcgtcgcttgatagacgaccgtttcttcaggaagtcgctcctctacctcgtccccatgtattcctcgagtctctaccgtatcggtctgcgtcgcctgggtgacttggtggagattgagaaccctttcgagtcggaacagatcgtgttgttggggtcttgccgtggcttcctttgcatttataatgagatcgacggccagattgctatatggaatccgtccactaggagttgtcagctcttgccacctgcagatgctgagatagcccatagattgggtccccctgcttgcgtttatggatttggatatgactattggaatgatgagttcgtgttgttgaggctggttcagaccatggaagatccaattctatcagttagcatctatagatcaagaggtagcgtgtggaggcggctccaggggataccaccatactctttggttgaaccgcgcacaatgggggttttcttgcgcggccgtctgcactggataatgagacgcgacccgatgcagaactcggcaatagttctggtggcttttgatattcatactgaaaactccgtggaggtacaacagcttaattttattgacaataggcttccaatgtatttggccatcctggaagggggtctttgccttattattaatgatgagcgagggggtgtcagtgcgtggattgcaagtgaatatggatcggaagagtcatgggctaggctgttctcgatagctgactactcgatgggtcgggtacttctccagccactggcttactcccagaacggtcgtcaagttttgctcctgtaccgtgagactctcgtttggtacgatttagataccggtgacgttgagaatataaacagcatgctaagcatctccaatacacctattgttggagactacttagggtctcgtcgtcggagactacaaggtgcgtggaggcagctcgagggtatgtcgtactctctgggtaatgcgtgcaaaagggggattttcctgcatggccgtctgcactggataatgactctccagctggtgctgaattcgacaaaagtgttagtggcttttgatattcgttcagacaaatttatggaggtgagcgagcttaattttatagataataggctcaacatggatttgaccctcttaggagggtgtctttgccttatcatttatggtgagcaaaggggtgtccatgcgtggattatgagggaatatggattaaacagaccatggtatatgttgttctcgatgcctggccactcaaggccgctattggcttactcccagaacggtcgtcaagttttggtggcagtgggcggtaagactctcgtttggtacgatagagtctggtacgatttacatactgggggtgtcaagaagttcggtaaaaggggcatgccaagttcctatgaagcagaaatttatttgcgaacccttgttccggtcggtaagccgccgatatgaggagggacgacttctgagctaatgacttgtttggaggatcgtcgatgatctgcatcgtaatcatccaaagtgaagtcaaatctgatgtaatctggagtgtactctgaatgcgtgttgtggtttgaatgtacttagatgccagtagtttctagcctgttgcatccgcttatttgctatattaacgtatattcagcaaaaaaaaaa

SEQ ID NO: 67 - DNA, 991 bp, Eucaluptus grandis
ggtgtttatcgcgtgctggaaacaacgaaggaaggaacgaaggaagcacttcgcgtgctgagattacttactctcttcggcggcgtcccgggcgagagctccgattcggttcgattcgattcgatttgcgatggccggaggagaagccttctcctcgaatcctccgccgcccaagccggcgattctcgggaacaacagcaagaccatcaatgcgaagctcgtgttgctgggggacatgggtgccggcaagtccagcctggtcttgcgcttcgtcaaggaccagttctttgattttcaggaatcaactataggagcagcattcttctcgcggacagtgggtgtcaatgatgcatcagtgaagtttgagatatgggatactgcaggtcaggaaaggtaccacagcttggctcctatgtactacagaggcgctgctgcagctattgttgtctatgacatcactagcaccgagtcatttgaacgggctaagaagtgggtggaggaacttcacaagcaaggaaatcccaatttgataataacacttgctggaaataagactgatatggaggataaaagaaaagtggcagctgaggaggcatgcatgtatgcagaagaaaggcgactcgtgttcatagaaacatctgctaagactgccactaatgttagcaaactgttttatgaaatagcaaagaggttgcctagagttcaggctatgcagaattcagcgccagcgggaatggttctagcagatacaagctctgaagaaacccgatctgcatcctgttgttcatgagttcttatcaactctctgtccattcctttcctttttcccctcactttctatagttgtctccactcaaagtaccttgatcttttagttcttgatgtatatgaataaaaacaaatccgaacaccacttgtgaaattggaaaaccaattggagttggggagttagtccatttaaacccagtaaattcctcggtgaaaaaaaaaa

SEQ ID NO: 68 - DNA, 1185 bp, Eucaluptus grandis
gggagagttcagaggtaaaggaggaaagcaaaaaaatggagattcctatgatagatttgagtgagcttgatggtaagaacaggagcaaaacaatggcactgcttcaccatgcttgtgagaaatggggctgcttcaagattaagaaccatggagttgacccagaactgatggagaaagtgaagcattttgtcaacacccactatgaggagaatttgaaggcaagtttctatgagtcagaaactgccaaatgcttggaaaatgccaatggtgccacatctgatctagactgggaatgcaccttctttatctggcaccgcccgaagtcgaacattgaggacttcccgaacctctcgaatgatcttcggaagacaatggatgagtacattgctcagctggttaaactagcagagaacctctcagagctcatgtgtgagaatcttggcctaggcaaggaccacataaagagggcattctcagggaaagatgggccctctgtggggacgaaggtggcgaaatacccggaatgcccctatccggaaaaggtaagaggactcagagagcacactgatgcaggtggtatcatactgctgcttcaggatgaccaagtcccaggacttgaattcctccatgatgaccagtgggttccaatcccaccatccacaaacgacaccatcttcgtcaacaccggagaccaacttgaggtgctgagcaacggccggtacaagagcgtctggcaccgtgtcatggctgtggagagcgggagccggctctctgtggccacgttctacaatcccgccggcgatgcgatcatctcgcctgcgccgaagctcctgtaccctgagaagtacacttttggggagtacctgaagctttatgccactaccaaatttcaagaaaaagagcccaggtttgagtcgatgaagagtgtgatgagcaatggatacaatggagttgtctaagagctgccaataactaaatggatcaggctcatttgtctctgtttggattttgtttttactttttcttgctttgatagaaacatggtcttgtggttatatatgccagttgtctcttttacagtgagttttgtgtaactcctaaagaagagatggtataagtctgtctttatcagctttcttggctctctttgtgctgatgttgaatgggctccaatgaaaaaaaaaa

SEQ ID NO: 69 - DNA, 1513 bp, Eucaluptus grandis
aatttcctgggtggctgcattttctttactgggctgctgctggagagacagaagaggaggaagaattcatggctacagttcctcaagaagcgatcaatgagctccaagctctgatggatcgagttgacgagccgttgatgagaacattcgagaacattcatcaagggtatcttaaagaaactttggtgcgttttctaaaggcgagagaaggcaatgttgccaaagcccataaaatgttattggattgtttgaagtggcgtgttcaaaatgagattgatatcattttgtcgaaaccaattatccctgatgacttgtacagagctgtgcgggattcacaacttattggattgtcaggttactccaaggagggactcccagtatatgctatcggggttgggcttagcacctttgacaaagcttcagttcattattacgtgcaatcacatattcaaatcaatgaatacagagaccgtgtaattttgccttctgcatccaaaaggtacgggcgacctattaccacttgtttgaaggttctagatatgtccggcctgaggctttcagccctcagtcagataaagttgttgactattatatcgactgttgatgacttgaactaccctgaaaagacgaatacctattacattgtgaatgctccatacgtcttttctgcttgttggaaggttgtgaaaccacttttgcaagagagaacgagaaagaaagttcaggtgttgcctggttgtggacgtgatgatctactaaagataatggattacagttccctcccacatttttgcaagggggaaggttcgggttctggtcggcatacatcatacggtccagaaaattgctactcgttggaccatccctttcaccaacagctttacagctatatcaaggagcaatctcagagacgtcaacccatccaacccatcaaacagggctcttttcatgttgcgctgcctgaggccgctgcagaagggacagagatcgctaaaaccatagaatccgagctacagaagtttgaaaacggaagtgggatgcctgactcactggatggccttaaaatcaatggcgagtgaagccgttgggatcaaaatgcttcggacgaccatttgcagcgatgaatctaacaagagctgatcattgccttgattcaactacgtgaacgatgatgtgtgggccatttccagtcacgcgacgtaacagcacagtatgggtggctctccctattgtctatgttatcttcttgaggtaacctgatccagccggatgtaccttagtgtactgaatagcctaaagccatgttcctatcagatgtatgacctggcatgttgtaatattcatttccatatgcaagttaacatcatttccacctagggatctcttggaggctctcagattttaaaggagatgttcctcatcttctttacacgatatgactgtcggatgttgcaaatgtttactagcaagtctagctagtcaatgtcttcggtttcgttgttcaaaaaaaaaa

SEQ ID NO: 70 - DNA, 841 bp, Eucaluptus grandis
ggatggcccgagcggggaacaagaacatacaagccaagctggtacttcttggggacatgggagctggaaaaacaagtctggtgctgagatttgtcaagggccaattccacgagtaccaggaatccactatcggcgcagccttctttactcaggtcttgtccctgaacgaagcgactgtgaagtttgatatatgggatacggccggacaggaaagatatcacagcttggctccaatgtactatcgaggtgctgctgcagctgtcgttgtctatgacctcactagcatggactcatttcaacgagccaaaaaatgggttctagaactgcagagacaagggaatcccaagttaataatgttcttggtggcgaacaaggcggacctggagcagaaaaggcaagtgctgagtgaggaaggcgagcaatatgctaaggaaaatggtttgtcgtttcttgaaacttcagcaaagactgcacagaatgtcaatgagcttttctatgagatagcgaagagaattgcaaaagctactccttcacgaccgactggaatgaagctgcagagacaagaaagtcgaagaagcttattttgttgctcggggtgattccagtgcttgctctcttaaggaaattgctgcgaatggctgtggtggatgcacctcttgtggttgtcgatgttgaagatggaatctcattctgaccctggctcgtgaatactttcatatgtacacagtatttcaccggacaaaatcctttgcttaccatttcaattgtatcaaattctccttcatgtggaaagggttatgaaaactcgtaagcaataagaaatgttgctccaaaaaaaaaa

SEQ ID NO: 71 - DNA, 1486 bp, Eucaluptus grandis
gtcggaggggagtaaccatgtcgacactcagcgaagacgacgaaaccgaaatcctcctgcggcttcccgtgaaatctctgctcaagttcaagagcgtgtgcaagccatggaactcactgatctcctctccctatttcgccaagacccatcttcagatttccgcttcttccccaagaatcctcctcgccaccaaccctcctctgtccgtgagctgcgaatcactccatgatgatgatcgtgccggccatgaaggtacgcctctaacccagcttcggcctccggttgaagctcccgacggatgtcgcccccgcatcgtcggatactgcgatggtttggtctgcttggagtacgacgatcatcggattgttgtcctgtggaacccggcaacaggggagtctagaaacatcccaaacgctagctgctcgtataaccgaccgaccatttgcggacttggctatgatccatcgactgatgattacaaaatattgcggcactgttccgttgcggatgcgtatgggtttccagaatatagcgtgttcgatgttttcgcgctgaagactggttcttggaggagagttcatgacaagcatgatgaatttaactattggccggaagctgggacctatgcgaatggtttccttcattggctagtcgtggggagagatccttgggaacacaagaagattgtttcgttcagcatgagcaaagagaagtttgaggatgcgttgttggcgctgccggaggccaatgaaggtactgggttcagagtattgggagttgccggtgaatgccttctcatatataaaagcatggcggaggtggacacttttatggcatggatgatgagcgactatggtgtgagatcgtcgtcgtcttggatggagttgtgtagtgttactctcccgaatcagacattaaacacttacttctacatgaggccattgtgctctaccagagcagggaagatagcattcagttcgatcggcacaacccgcttatctatgatcctgagaaatgttatgacaaagtggttcgtgaaggaggataaattagactttgtagtgtacgttgagagttttgtttcacctcatggagcaaagctgcagaatcaatatgtgtctcgggtgaaggagcctatggagagaagtgacttcattggtgatcactcagtatttaaagaaggggaaacttcatataagaaagccaatagccatcttagcagtaaaaggagaaaagcttcctagagggctagttgtgatgtggatgcgcaggtcgatatattgtgaagtcaaaggggtgactcagtaactgctttaggcactttgttcttctcttttgtgggttccttctggattactttgtgtgtctgtgtttggtcgggatggcagacttgtttctttgtttacttgtataacatttttgtaattcctctttccacaaatcaaagccctgatgaaaaccaaaaaaaaaaaaaaaaaaaaaaaaa

SEQ ID NO: 72 - DNA, 1164 bp, Eucaluptus grandis
agagagagagagagagagagagagagatggagatattcccagtgattaacttggagaagttgaatggcgaggagagaggagttactatggagatgataagagatgcttgtgaaaactggggcttctttgagttggtgaatcatgggatatcccatgagctgatggacacggtggagaggctcacaaagggtcactacaaagaatgcatggagaggaaattcaaggaaatggtggcaagcaaagggctcgaggccgttcagtctgaaatcggcgacattgattgggagagcaccttcttcttgcgccatctccccgtctccaacatctctgaagtccctgatctcaaagaagattacaggaaggtgatgagagaatttgcactggagatagagaagctagcagagcaacttctagacctgttgtgtgagaacctcggtctggagaaagggtacctgaagaaggtgttctatggatccaaagggccaacatttggaaccaaggtgagcaactaccctccgtgcccgaacccagagctttttaagggcctccgggcccacaccgacgccggtgggatcatccttctcttccaggacgacaaggtcggcggccttcaactcctcaaggacggcaaatggatcgatgtccctccactgaggcattcgattgtcatcaacttaggcgaccagctagaggtcattacaaatggcaagtacaagagcgtggagcaccgggttattgcgcagtcagatgggaatagaatgtccatagcatcgttttataaccctggaagcgatgctgtcatctgtcctgcaccagcactattgaagaaagaagcaggagaggaaggccaagcttatcccaagtttgtgtttgaggactacatgaagttgtatgcaaggcttaagttccaggcgaaggaaccgagattcgaagccatgaaagccacggaatccaccattgctaggggtcctatcgcaactgcttgagtgttgaatgacaagtttcttgttactaagaatagggtcttgtttcatggtctactaatgtaatgaatctcgctctttatctagtgctggagagtggctgctttgcttgtgttaagtaatgtgtttatcatgacctttgaactagtgatttctgaggctttttatttgaaaaaaaaaa

SEQ ID NO: 73 - DNA, 1493 bp, Eucaluptus grandis
atccttcactccgactctccacccccaccatctcctcctccgccacaccactaccaacaccaccaccatcaccaccatgcaagtctctcaacctgctcgtccttccgatccaatatacaggcgagacgatcacttgtcacaagcatgcaaagacttggtgtcctctctcccttctgaagaaggctgggtcgcaacctctttctgcttgtaccagggcttctggttccccacttggctcttcaacggtgtcctcgcttgccaaaaccacttccaagctcaaccctctgacatcctcctcgtcaccaacccgaaatccggcaccacctggctaaaggccatcctctttgctctcttgaaccgtgccaagtactctgactccgactcaaaacaacgccaccctcttctaacccaaaacccccacgatcttgtgcccttcttggaggtcaagttgtatctccagcaagaaaatcccgatctcactactttcgagtccccgaggctcttcgccacccacttgccctattcgtcacttccagggtcggtgagggactccaggtgcaagctggtttacctgtgtaggaaccctaaggacatgttcatctcgctgtggcactacgtcaacaagcggagggccgaagagaagggccagattccgctcccaaagtgccttgacaagttctgtcgaggattgagcccctacgggccttattgggatcatgtgatgggttaccacaaggcgagcttggagatgcctgagcaggtgttgttcttgatgtacgaggagttgaaagaggacccgcgtgttcatgtgagtaggttggctgatttcttggggtgtccgttcagcgatgaagaactgagagacggcactgtagagggaataatgaggatgtgtagcttcgacaatttgagctcattggaggtgaataagagcgggaagctgtggactggacaagagaaccagtggtttttcaggagagggaaggtcggagactgggtgaattatctgagtgctgagatggccgacaagattgaccaggtaatggaagagaagttgcgtgattctgggttgaactttcagtacaaataactcactcgttcaataatttccgtgggctgtgttaattttaaagatgtttggtttgatggtggagaaaaaaaggcacaaaaagttaaaaaggaaaaaaaaggaaacgactcgtttgttcgcactttatgaaagtgtgattcttatgctataggatcaaagatttttagtggcagtgtcgatcgtggcttcgtatcaataatgagacgcttcaaggttgtgtttctgggcaccagctttgttgtactattggcttttgcagatgctatttggccaacacttagttggccaataaaaagcagctttccatctttttctttttgccgtgtgaagctttgtgatgtatggtcttgtgtagatcgaattgctaaacaactgatatgtgtggtttggattaaaaaaaaaa

SEQ ID NO: 74 - DNA, 2567 bp, Eucaluptus grandis
tggggttctctttctctctctataagacgcattgctccctctccctcccccttttggccctccgtgcgctccaaagctcgctcctttgaaccccgcgcgagcgagacggggaggtgggcagccagcttttcgcctttctcgaactgggtcggctccctttttccgcctcccgcctcccagatctcgccctcgccccctcgccggcggccgggcaaaggcaaaggcaaaggcaaaggccgagtctttttgatcggccggtgatgctcagcggctgacgtgggccgctcctccccggttgcgctgcccgcatggatccgacgaagaagccgcgggagtcgtcctcgtcgacggcgtcggcggcggcggcggagttcccggacgaggtgctggagcgggtgctggcgctgctagcctcgcacaaggatcggagcgccgcgtccctcgtgtccaaggcctggtaccacgccgagcggtggtcccggacgcgggtcttcatcgggaactgctactcggtgacgcccgagatcgtcgccggccggttcccgaagatccgcagcgtcacgctcaaggggaagcccaggttctcggacttcaacctggtgccgcagaactggggggccgacatccggtcgtggctcacggtcttcgcggagcggtaccccttcctcgaggagctgcggctcaagaggatgaccgtgacggacgagagcttgaagtttctggccctgaaatttccaaacttcaaggctctctcgctcatgagctgtgatgggttcagtaccgatggtcttgcggccattgcgactcgctgcaggaatttgactgagctggatatacaagagaatggcattgatgatattagtggtgactggttgagttgcttccctgagaacttcacatctttggaagtgctgaacttcgcaagtctaaatagcgatgttgattttgatgctcttgagcggcttgtaagtcggtgcaattcactgaaggtccttaaggttaatagaactatttcactagatcagttacagaggctgcttgtccgtgctcctcggttaactgagctcggtactggctcgtttttgcaagagcttaatgctcaccagtactcagagcttgaacgagcttttggtggctgcaagactctacacacgctctctggattatatgaagctatggcaccatatctcccagttctatacccggcctgtgcaaatttgactttcctgaatttaaatgatgctgctttgcaaaatgaagaacttgccaagcttgttgttcactgtccatgtcttcagcgcctctgggtacttgacactgtgggagacgaagggctgggagctgttgcgcggagttgtccactcctagaggagcttcgggtcttcccggccaacccttttgacgaggaagttaatcatggtgtttccgaatcagggtttcttgccatttcatatggctgccggagacttcactatgtactctacttctgccgtcagatgacaaatgcagctgtagccacaattgtgcagaactgccctgattttacacacttccgtctttgcataatgaacccagggcaacctgattatctgacaaatgaacctatggacgaggcttttggtgcagttgtgaagaggtgtacgaaactccagaggcttgctgtttcaggtctcctaactgaccagacatttgagtatattgggacatatgctaaaaatctggaaacgctttctgtagcttttgctggaagcagtgaccgggggatgcagtgtgtgctgaggggttgtccaaagttgagaaaacttgaaatcagggattgtccatttggtaatgcagctcttctctcgggattggagaagtatgagtctatgaggtcgttgtggatgtcggcctgcaaagtgacaatgaatgggtgtgcggtattggctagggagaggcctagattgaatgttgaagtaatgaaggatgaggagagcagtgatggtcaggcatataaagtttatgtttaccgcactgttgctggaccaaggagagatgccccaccttttgttcttactctctgaagtgattatttcaaggcatttgttgctatgtgaatttgtctgattgaagtggggagcaccggtgcagagagtctgagggtgtggaattcacagaaagctcgaacattctgttacctatgtttctgcggttcagctaattccagattgtgaaggcacacaaaatggataatctggtgggaaaaacaacgtgtagtgtctgcctccatttgcttgaaggtgctggaaagcgtatgatgcagtcggtgagatggagttcaaaagaaacaccagagatctgccaaatgtctcgaagcatcggccgacagctcggggacttgaacccatgaaattttccccttgcaagcgcatcaatctctgcaacattcttcatcaattgcaagacatcatcaacagctgggagaaaagatgatgattttcctgatgttttgactcatctttccctggtgacttccatccacagcaattgcaaggaatcctttatggatctctcgcttgcaatgtatg

SEQ ID NO: 75 - DNA, 1818 bp, Eucaluptus grandis
attttttcatggggatcgtcaagctgataaaaccgcacgaggttctgacgagtccggataatccccttttaattaatcaagcttgattaaaccgcagcttaatttaattaagttgattaattaaatcggattccccgaaatgggatgacgtgctataaggacgtagccactgccgtccgctcgtgcacccaaggcgcagcaccgcacgctctctctctctcttctttctctctctatctgcgcgtcccgacttctggttcgagcttgtgcttagctttgcaagagcagacgaagccgaggtgagaggatcgagcagcgttgcagcggagcgaccgggcgagcatgtcgtcgtcggccgtgcagttcgccgccgcttctcgcgacggccacgagaacaacggcgggggcggaggggacagcagcggcgagcggctcgaccccaccgccgtcctcctccccgtcgatcccggggcccccgacctgtccctcccccgggagaccttcctccgggcggccctctctctcaaggaccaggtggtgcaggcgacgtggcgcgagggcggagcggccgatccgaccgcgtacacggggctgctcgggacggcgttcctgtgcctgaggtcgtacgcggccaccggcgaccggggcgacctgctgctgtcggccgagatcgtcgacgcgtgcgcttccgcggcgcgtgcttccacgaggcatgtgacgtttttatgtggtaaaggaggggtgttcgcggtgggcgcggtggttgccaatcttctgggggaccatcataaacgtgacttcttcctcaacctattcctcgaggtggcacaagagagggctctcccggttggacctgaggagggcggttttgggatgtcgtacgaccttctctacggccgagctggtttcctgtgggcggctctatttctgaacaagaacctgggagaggagacggtgccgaacaatgttctgatgcctattgttgacgccgtgctggctgggggcagggccggtgcgtccgatatcgctacgtgcccattgatgtacagatggcatgggacccggtacttgggcgcagccaacggcctcgctggaatcttgcaagtgttgcttcactttccactctgcgaagagtacctcgaggatgttaaggggactttgaggtatatcatgagcaagaggtttccgcacagtgggaattacccctcgagcgaagggaacccgagggacaaactggttcagtggtctcacggcgcgacggggatggccatcactctatgcaaggcatcacaggtttttccacatgacagagacttccgtgatgcggccatagaggcgggggaagttgtgtggaagaacgggctcgtgaagaaagtggggcttgctgatggcatttcagggaacgcgtacgcctttctctcgctgtatcgcttgacgggggagagaatctacgaggacagagccagagcgtttgcgagcttcctctaccacgatgccaacaagcccgtcggcacggggcacgggcacgttgcggactatgccttctccctctaccaagggctcgccggggcggcttgcctctggttcgatctcgttgacgcggagaactccagattcccagggtacgagctataagggaaggaacgcgaatgcgaacacacgagagtttacgtatagctctttcgtgtacatactaatgagaggtatgccgttacaaatcacgtacgctgttgctctattgctacagtcaatatatgtaaggattgcaacttgacaatcccacgtttgaggcaagaaattggtatccgaaaaaaaaaa

SEQ ID NO: 76 - DNA, 2189 bp, Eucaluptus grandis
aaccatcaagttcagccttccccgccgtgcagcacttcacctagatgcttgtcgacgaattccagttggcgacctaaagcgcttctcgaccagccagcagttgcccagacgatttccggtgacctccgcggcatccccacaccggagacccttcactgctgcagctgtcctctgctgattccgggcttgggttgccattcactgttgttcctcctgccgattgctgttcgctacaacagatcacgacacctgtaacatcggcaagctcccggttcgaaggaccgctcacagaccttcacgaattcaagatcctcacgtatccaaatttcttgaagagattaataaaggtgaggccttgaagggataagtccaccatctggagagcagcccgtgacttgcctcgtgtccatgcctacaaggccttggtgtcattggtgttaactgtccattgaaggaacactcaacccagtagcgaaccagcaagctaccttgctgttacgcacatgtactgacgaacccagccttgccgaaatttttagacgatctcaacgactcgctcctgcacctcaattgtgaaccccccaccttccgacactagccgccgttcttgttcgtatccaaaccgagtcgattctacgaagttcttatttttgcaggttcgttcaccgtgagcccacggtcgtcctttactgaggagcaccaccgtgccgagcttcaaattttgttcttgtcgagttcaaattttgcaatattacttgtgaaaatttaggattaataggcttcaaagcttctccttacaaagatgcaaatcttgcccagtcctgaagaatccatcacctgtagtggcccgcactatgacagagcgaaagaagcaaaggaattcgacgagaccaaagccggcgtcaaaggcctcatcgactccggcatggccaaggtccctcggctcttcatccaccctccccagaacctgcgcgacttgtcctctgacacagaggggtccgccactgacctcaaggtccccatcatcgacatgatgggctgtcaggattcccagctgcggcgagacgtggtcgacgacctccgtagagcgtcggagacgtgggggttcttccagataattaaccacgggatcccggtcgatgtgatggacggcgtgttggaagctgtcaagcagttccacgagcagcctgagggagtgaagggagagtggtactccagggacgacgctaggaaatttaggtactacagcaatggagacttgttttggtccaaagcagcaacttggaaggacactctcctgtttgatttcccgtttggagagccagaccgagaggcagtccctcttctattcagagaaacggtttttgagtacgaaaaacacgtggaaaaattgaagggatctctgtctgaactactatcagaggcactggggctcgattcaggctatcttggtgacattgaatgcatggactccaagagaatagtaagccattattacccaacttgccctgagccagagctgactctgggcacaatcaatcactcagatgccacatatctcactcttctcctgcaaaaccacaatggtggcctccaagtccggcaccagaaccagtgggtcgatgtctccccggtgcctggagccatcctagtcatcattggagacttcatgcagcttgttagcaacgacaagttcaagagtgtggagcaccgggtccttgccaggcgggctgggccccgggtctcagtcttgtgcttcctcttcccaggggagacgcgtaagtcgaagccgtacgggccgataaaggagcttctcgacgagaacaatccgcccatgtacagggagacctctttcacagagtattttgggtattacctctccagtggcaatggcctcaatggcgaatctgtgcttcctcatttcagagtaagcgagcccaagtagagagtagaaaatgcaacaaaaatctttgaagaaggtgtcggccttcacatgaaatccgatggctgtcttttcattgaatgtagcgataggaccacacctcgaaaagaataatcagaatctactttgatttgatcgagactgaaacaagaaattgccaaaatatgatggcatgctccttcagtctctgtgaaagcatttgaatctctttcccctaaatttatcgcgagtttcatcaaaaaaaaaa

SEQ ID NO: 77 - DNA, 2781 bp, Eucaluptus grandis
ataatggatgccggagatctcggttcggagaagtcttctgagaccacgcgtgagctcgtcgtcatgtcgtcgagattttcagatgggtcctgctctcgagaagtttagtgtcggatggattgaactggctgcccagcttcaatgcaatgttaaagaaattagcttccgggatttttatctcttctctgctcattaccgtttcagtggctgataatggattcccacgatgcaattgcgatgacgagggaagtttgtggagcgtggaaagcattctggagtgccagagagtgagcgacttcttgatcgccgtggcctacttttcgatcccaattgaattgctgtattttattagctgctcgaacatcccgttcaaatgggtcctgtttcaattcattgccttcattgttctgtgcggattgacccatctgatcaatgggtggacttatgcccaccatcccttccaactcatggtcgcactcaccgtgttcaagattttaactgctctcgtctcttgtgccacggcgataacgctcatcaccctcattcctctgcttctcaaagtgaaggtgagagagttcatgttgaagaagaaggcttgggatttggggcgagaggtagggatcataatgaaacagaaagaagctggtttgcatgtgcggatgctcacacaagagattcgcaaatcacttgataggcatactattttggacacgaccctggtcgagctgtccaagacactggggttgcagaactgtgcagtttggatgcctaacaatggtaaaaccgagatgaacttgacgcatgagaggggaaggaattactcaggaacctatcacatccctattccgataactgatccagatgttgtttcaattaagcagagcgatcaggtgcatattttgagacctgactcagaactcgcaactgcaagtagtgtagggcctggggagtccggcccagtagccgcaattcggatgccaatgcttcgtgtctccaacttcaagggagggacccctgaactccatccagcatgttatgcgatactggtcctggtccttccgggtggagagccacgatcttggagcaatcaagaactcgagattatcaaggtggtggccgatcaggtggcagtggctctctcacatgcagcaatccttgaagagtctcagttaatgagagagaaactggaggagcaaaaccgggctctacagcaggaaaagaggaacgctatgatggcaagtcaggcccgaagctcattccaaaaggtcatgaacgatgggctaaagaggcctatgcacacgatctcagggttgctctcgattatgcaggatgagagtttgaatgcggaccaaaaaattattggaaacgcaatggcaagaaccagcgccgtcttggcaaatttgataaatgatgtggtgaacatgtcaacgaagaatagcgggagatttccattggaagtaagatcattttctatgcatgacatgataagagaagcagcttgcttggctaagtgcttgtgtatctacaaggggttcagttttgaattggacattgataggtccttgccgaacaacgtaatgggcgatgaaaggagggtttttcaggtaattctgcatatgatcggtaacttgctgaatgacagtaatcaagggaaattagttacccttcgaattcttcgtgagaaagccagtggaagtcagggaaggtatgatcgaggttgggtgacgtggaggtccgaatcaactgatagaggtgtgcgtatcaaatttgaagttggaataagcgacgacatttctctgttggagaggtcagtttcgacaatccagcttggaggtcggaaatacaacagtgatggggttgaggaggacttcagcttcagcatctgcaaatggctagtacagttgatgcaaggtaacatctgggtagtcccgaacactcagggcttcgctcagagcatgacacttgtcctacggttcccactccgagagtccatctcagtgaccatttctgaaccggggccatctccagattatacactctccaactcagtcttcacaggcttaaaagtattgctcgtggactctgacgatgcgaacaaggccgtcacccggaagcttcttgagaagctaggctgcaaggtgtccactgcctcttcgggattcgagtgcctcggcgctctccgcccctctgaatcttctttccagattgtccttttggatcttcacatgcccagcttggacgggtttgaagtggcaaataagattcgccagttccacagcagtaccaattggccagtgattgtcgccttgaccactagcggtgacgatatttgggaacgatgtttgcaggtcggaatcaacggagttatcagaaaaccagtcctcttgcacggaatggccaacgagcttcggagagtcctgttgcagccaagcaagacgctgctatgaaatgtggatgaagcttcattccaagatgtaatgcctcaatgtcaataacttacccttcctccttattacctaccaagattttcaacatataaaagttgtcctacacacaaaagaaggctcagtcaccattagaaatgtaacatactagtcctttttcatgcccttgctttttatgcattttgtagtgatcagagatcctttctagattgccattttggcaaaacatgtcagctcttcgagaaaactaaattattgcttgctagtttttaaacgatacatgtatgcaactcacatttcagtgaaatagatatgaactcttggcccaaaaaaaaaa

SEQ ID NO: 78 - DNA, 1002 bp, Eucaluptus grandis
ctcgccctctccctttctctctctacccttcactctctctctctctctctctctagagaaagaaggaattgaacgatagcaatggcgggttacagagccgaagacgactacgattacctgtacaaggtggtgctgatcggggactccggggtgggcaagtccaacctcctctcccgcttcaccaagaacgagttcaacctcgagtccaagtccaccattggcgtcgagttcgccacccgcactctcactgtcgacggcaaggtcgtcaaggctcagatttgggacaccgccggtcaagaaaggtaccgtgccatcactagtgcttactatcgtggagctgtaggtgcactccttgtgtatgatgtcactcgccatgcaacatttgaaaatgtggatagatggctgaaagaattaaggaaccacacagatccaagcattgtggtgatgcttgttgcgaacaagtctgaccttcgtcatcttatagcagtctcaacagaagatgggaaatcctatgctgagagggaatcgctgtacttcatggaaacctctgcactagaggcaacaaatgtagaaaatgcctttgcagaagtgctaacgcagatctaccgtaccactagtaagaagacagtggaaggagatgatggatctgctgctgcgttcccttctcaaggagaaaagataaatatcaaggatgatgtctctgctttgaagaaagttggctgttgctcaacttaaggttggaggtgattgttgcttgcatagattaatactttgatttcagttgtataacatttttcatgcccaaaagctgaagaaaagttagctagaagaaacttatgagacactaaatttgtgcagcaaaagcttagtacatcatgcctttggcatggcagtaggatagctgcataagttagttatttctctgttctgattcatgcaaagccattatttaggcagtttcatctttctgagaattaacaagatgttgctttaaaaaaaaaa

SEQ ID NO: 79 - DNA, 1461 bp, Eucaluptus grandis
gcaaccaacctcctcctccacctacgccaccactaccaccaccatcaccacgcaacgcaccgcggccgcggccgccaccatgcaaccctctcaacctcctcctctcaatgaaaattacttgcgagacgacgtcaagtcgcaagaatgcgaagacttgcactcctctctcccttcggaagaagactgggtccccacctctctcccttcggaagaggactgtgtcccctccactctccgcttgtaccagggcttctggttcccctcttgggtcttgaacagcgtcgtcgcttgccaaaatcacttccaagctcacccctccgacatcctcctcgtcaccagcccgaaatgtggcaccacctggctaaaggccatcctcttcgctctcttgaaccgtgccaagtactctgactccaactcacaaaaacgccaccctctcctaacccaaaacccccacgacctcgtgcccttcttggagttcaggctctatctccagaataaaaatcctgatctcactgcttttgcatccccgaggctcttggccacccacttgccttattcctctcttccacggtcggtgagggactccaattgcaagctggtttacttatgtaggaaccctaaagacactttcatctcgatgtggcactacttcaacaagttgaggcccgaagagaagggccagcttccactcccggagggcctcgacaagttctgccgaggtgtgaactggtgtgggccttattgggaccatgtgctgggttaccacaaggcgagctcggagatgcccgagaaggttttgtttgtgaagtatgaggagatgaaagcggacccgagcgttcaagtgaggaggttggccgatttcatggggcgtccattcagcgaagaagaactgagaaacgggaccgtggagggaatattgaggatgtgtagctttgacaatttgagtgcactggaggtgaataggagcggcaagttgccatctggactagagaagaagtggttcttcaggaaaggcgaggttggagattgggtgaattacatgagcgctgaaatgggagagcaaattgacggtgtcatggaagaaaagttgcatggttctggtttgaagttttaggacatatgacccactcgaagatgtttggtttgatggtggaaaagaaaaatgtgtgtaaaaagaagaaaaaagaagcaaaaacgattcgactctccgcactttagggggtcaatgtctggatgaaagatcttcagtggcattgtcagtcctggtttcgtctccatagtgagatgctttaaggttgtgattctagtcttcatctgtgttttgtactattggcgtttggcagaagttatttggccagtacgtagctggctaaacaagagctgcctagctgctccctgggagcttgtggatgtatcttctgttatttatttcaattccatttttctttttcaaaaaaaaaa

SEQ ID NO: 80 - DNA, 1057 bp, Eucaluptus grandis
gttcgccgagcatcatcgaagcgaccgtccgtcctcccctcccctcccgatcgcgcatgaggtttcctcctagatccggctgatcgactaggggggcgatggcgattctgtacgcggtggtcgcccggggcaccgtcgtcctggcggagttcagcgccgtcaccggcaacaccggcgcggtggcgcgccggatcctcgagaagctcccctcggaggcggactccaggctctgcttctcgcaggaccgctacatcttccacatcctgagatccgacggcctcagcttcctgtgcatggccaacgacaccttcggaaggaggattcctttttcatacttggaagatattcagatgagattcatgaaaaattatggcaaagttgcacactttgcacctgcatatgccatgaatgatgagttttcaagggttctgcatcagcaaatggaattcttctctagtaaccccagtgcagacactctgaatcgggtccgaggcgaagttagcgagatgcgaactataatggtggataacatcgagaagatactggacagaggtgatcgaattgagctacttgttgacaagactgctacaatgcaagatggtgcctttcacttcaagaaacagtccaagcgccttcgtcgagctttgtggatgaaaaatgcaaagcttttggcactgttaacatgcttgattcttgtgctgctttacattattattgctgcttgttgtggaggcatcactttacccaactgcagatcttaacctctatagttgctggtgttgatctccggtaagtatatatgccatgggtgatatttgggtcacattcagggtcctatttgtaacttgagaagcgctcaaatggaattatgatgcgccactgtctgctaaatatcaccctgttgggaggtgctattctggtttttggggagtctgatggggtccatcgcttccattttcttgatgagtttgttgtgtattttcacggggcatctctacactgatgtaaataatgtacttatttatagctgacagtcgagcttttgccaaaaaaaaaa

SEQ ID NO: 81 - DNA, 3025 bp, Eucaluptus grandis
ggcaaagtttaggagaagaatatgacaggaaccatgatcggagtcaccaacgccaatgaacaacaagccctcgacagagcccaagaggtccgacaatttgaagactccaaccttggagtcaaaggcctccttgactcgggcctctccaccctccctcccatgttcatccacccgcccgaccttctatccagcctcaagcctgtggttgggctcaagaccgattcaatccccatcattgatctctccggctccaactccgaccgacgaccctcagtcatcgaggaagttgcacgtgctgctcgtgagtttggcttcttccagatagtcaatcatggcgtgcccacggaggtcctgggtcaaacgatcgcggcagtgaaagcgttccatgagcagccagcggaggtgaaggctaggatctatcgaagggaatctgagaccggggtcgccttcttcgcctccagcgtggacttgcttcactccaacgtggcttgctggaggtaatgtgaatgtcaatttctatgttgggtcgacaagacaggaacattagtgactcgaaattaagaaaattaccaaaaaaggtcttaaatatgttgcatgggaggctaattcaattttaaacatttttgacagtttgcaatatagtcattcaagctaattttggcaagaaattattaaagtggacatcgtttgttttatgtgacacacctgacactaatattcgtaatttttgtatttttttaacttctttttttttaattttttttttacgtcggccatgccatgtaaaattgcttacatccatggcaacgaagttctatcaaaattttatattatcaaatggttaaaagatttcaaattaaattaatcaaattgaaatagcaaaaaagccaccaaaaattccaaattttactcattgtgacaaatatacctcaaactttttttgtgagataaaataccccaactttaccaattgtgacacatttaacccaaacttttttgacacaaaagtcccaaatttatacatgcatgacacatttaccccaaactataaggtattttcgttttttactttttaaattttttttctctttatttttctgctttcttctcctttcttccctccgctggcatggtggagagaagccggactcaggcgaggatccttaggtcgggcgaggatatccctcactagattcggcaagggcaaccctcgcctcacccaagcgagggctgcccgagctaatgccaaagaggcactcaccggatttggcccaagcgaggaccaccctcacccgcccaagtgagggtgacccttgcccgatgccagtgagagcggtcctcgcctgagtccagcttccctccactagccacggcgaagggaagaaagaagaagaaagaggaaaaaaaattaaaaaaaaaaaaaacgaaaaatgcccttcaaccatggagttggggtaaatgtgttacagttgataaagtctgggattttttgtgtcacaaaaaaatttagggtaaatttatcatatttggtaaagtttggggttttttgtggcattttcccattaaaatatttagaaccgaattgatttttgtactatatatatatatatatatatatatatatgactttttcagtaattatcatcttgaattgatgtgaatattaaattgtccttttgtataatcgaaattttcattgtcccaaaagaagtttcatacacacacatatttgcaaattatatgaatttatcagtgacaatacaatgaatgggacgaagtactaatgcgcaccaatttatcagtgacaatacaatgacggggcacagagtattaacgtgcacgaatttatttggtctttttcttaaccataaacatcttaaacatttacactatataaattaggacacttgagttcatataattttcatactttttaaaaatctatataatatattaaatttgaacaagcgagaagaaatgttcctcggtgatatacaagaagcacaaacaatgtgcaaaaagcaaatagaaagagtgtttgcgtttttttcttaattaaggtgaagaataagaagaaattagttcagtgcacgaagtaaatattacagggattcgctccggataaggtcgggtcctgtactcccagacgaggaagaaataccggaggtgtgcagaaatgaggtgatggagtggaatcaacagacccaacacctcggagtcctcctgatgggtctgttgagcgaggggttaggattgagtccgagcaagctccaggacatgacgtgcgtggagaagcgaaacatgttggggcattactatccttactgtccccagcctgatctgactgttggcctgaagccccacaccgacaagggggtgatcacggtgctcctgcaagaccaggttggcgggttgcaggtgaagcacggcgaggcgtggctggatgtgacgccctctccaggtgttctcattgtgaacatcggcgaccttctccagatcatgtccaatgacgagtacaaaagtgtggagcaccgagtgttggccaatccaggccctgaaccacgcctgtcggtagcggttttctactatccgcttgaatgcgaaaaccagatcggaccgatcccagagctcgtgtcaccagagaaacctgctgcttttcgacaattcaagcttggcgagtacctgaagagattccaaactgaggtgctggatgggaaaactttgaaaaatcacttcaagacatgatataagaggcatctaggctaatatagatggtgcaagaataagatgcttccttatttttaataagaagcaatcgcttattaagttgtaagttcggtttggattcgctagaattccaagccattgtcctagttcaaggacgctgtgtgcctatatttaagaacgagtcatctcgtttcctccacaataagtcggtatgtctggtaacaggaacatatactacttcctcatcctattttaactgcacttctcatcgaaattgtctgtcctataactctcttac

SEQ ID NO: 82 - DNA, 1330 bp, Eucaluptus grandis
ccgcctttaatatataaatatcgtcccctccctctccctctccctctcgtgtccaagtaaaaggaaaaagaaaagagacagaaaacagaaaagcggcggcgatggtggtggcgagtccgaacccacgacgggccgagaagatccaggccgtcgagctcccggcgatcgacctctcgccgtcggggagatccgcggcgccgcggctcatcgtggaggcctgcgagaggtacggcttcttcaaggcggtcaaccacggcgtccccgccgagatcgtgtcgagaatggacgaggcgagcgccggcttcttcgcgcggcccgcctccgagaagcggctcgccgggcccgccgacccgttcgggtacgggagcaagagcatcgggttcaacggcgacgtcggcgaggtcgagtacctcctcctcgagtccgaccccgccttcgtctcccgcaggtccgccagcatctccgacgaccccacccggttcagcgctgctgtgaatgtctacatagaagcagtcaaggacctggcctgtgacatattggatcttatggccgagggcctgggggtccgggacacgtcggttttcagcaggctcatcagggccgtcgacggcgactcggtcttccggatcaaccactacccccagtgcgcggtccttcacggcgaggtcgggttcggggagcactccgaccctcaaatcctgaccgtcctccgatccaacaatgtgggcggcctccagatctcactcgaagacggggtgtggaccccggtgcccccagaccccgcagctttctggatcaatgtgggcgatcttttgcaggccatgacgaacgggaggttctcgagcgtgcggcatagggcggtgaccaaccccttcaggtccagaacgtcgatagcgttcttcggggcgcctccgctggacgcgcggatcgctccccagcgggagctcgtcactcctcgaaggccccgtctctacaaccccttcacctgggccgagtacaagaaagccgcctactccctcaggctcggggacaagcgtctcgacctcttcaaggcctgcagagaagacggcggcatcgatctgtgagcagatggaggagatgggtcgtctcttttctgcccttttctctctctcttgttgctgggcctgtcgtgaagggaattttgggtttgcgtgttctgctccccttcctctgtttttagcagcaaagagaagctctcctagtgttggtgtactgttgtaatcaatggaaaggtatgttaggcgacgatattatgttttggcttttatctatcaatcgacccatcggttgattttatctaaaaaaaaaa

SEQ ID NO: 83 - DNA, 2364 bp, Eucaluptus grandis
gtccagattgctctcgacatgtacagaatacaagcagggtcggcagcagcggcaggggtcgagcctggatactgtgttgagaccgatcccaccggtcggtatgctcggtttgaagaaattctgggcaaaggggcgaccaagacagtttacaaggcgatcgatgaggtcctgggaatggaggtggcgtggaaccaagtgaagctgaatgattcgtttcggtctccggacgaatatcagcgtctgatctcggaggttcacctcctcagcaccctcaatcacgactccataatgaaattccacacttcatgggtcgacgtggatgggacggccttcaatttcatcaccgaaatgttcacttcaggcaccctcagaaattacaggaagaaatacccacgattgcacatccgagccataaagaattgggctgttcaaatacttcacggcctcgtgtatctgcacagccacgatccgccagtaatccacagagatctgaagtgtgataacctctttgttaatggacatctgggacaagttaaaattggtgatcttggacttgcagcgatccttcatggttctcgagcagctcatagcatcataggcactccagagtttatggcaccagaactctacgacgagaattacaatgagctggtcgatgtctactcattcggcatgtgtgtcttggaaatgcttacttgcgagtatccttacattgaatgcaccaatccggctcaaatttacaagaaagtcacgtcgggaaagttgccagaagcattctaccgtatcaaagactcaaaagctcggaaatttattggaaaatgcttagcaaacgtctcatgtagagtatcggcaagggagttgctacacgacccatttcttctaagtgatgaaggtgaccgcctcccaggattgaagttcaaaatgccggagccattcttgaatgggagagatgtagataatctgcgtgcaagggataatccactcaggaccgacatgatgattacgggaaagttgaatcctgagggtgacaccatttttctgaaagttcagattgctgatagaaatggtttgaatcccaagtatcttcctgcaatccattagaactattgagagcacagaatcactgtacacaatttctctgatgcatcagtactaagttttgtaaattagttaagaagaaagcatgcagattgtggattattatccggtaccatttgcaaaaaatcgatgcctcaaactagttatatattgccctaaatagaagttgaaggggaaaatggctgaacgcatataattctcagaactcgttaaattagagactatagaaatttctggccagacttatcttcacagatcttccagagtgatgaaactaatgaaggttgtcttcatttccttcccattacccatgcaggttcagcgagaaatgtctattttccttttgacgttctaaatgacactccgattgatgtcgcaaaggaaatggtcaaggaactggagatcatggactgggaagcggaggagatagccgacatgattggtggagaaatctctgctttagtacctaactggacgaaacaggacatgacagactacaatcaggaaaatgacgacggctttgctccaccttttctctcattctcttcaggttcgtcatcacaggcatcgccatcgggctttacggcctacagggaaaatgaaatcgcgtctgactacggttgtctccaggatgtgccagatgatatgagctctccaagctccatacattctggcacatattcccacacaagttacttctgcccggaagatcaagaagtgaaccccggtccttcaaacccagatcaacaccttatcagcagaagcaacagacatacgaggttttgcgccgacgactaccaaaggccaaggcaattcaaggataggagtcagaccttgcaatgccaggtcctgacagggtcagatagagattcttcctccgtcattaaccggaggatggccggccacagactttcacggaataggtctctggtagatgttcatagccagttacttcacctctcattgctggaggaggtgagcaagcggaggctgtccaggacagtcggagaagttgagaacatcgggtttcaggcaccctttgagatatcaagaaacgccccctggattggcggatctagtttcatcagcagctcgaggaataaaaagggccacaggattcaaaacagaagaaactgaaatctgccctctctcatgagcatctaaagatggtaatttgtatcaaaatgtcagcaatttaggactgtatccaccctgcaaagatcaaaagtattagccttgtagcttaaataagtttcaaaaaaaaaa

SEQ ID NO: 84 - DNA, 1204 bp, Eucaluptus grandis
tgtcagtctccctgtccccgcctctccgtctcatcatcctcctcctcgtccctcgtcatcgctttcctccatcaaatcagcgtctccctccctccctcgctcactgtgatcccagaccagcgccggctgctcccgggctcgaaatctccggcgacgtcgcccgcccgccgaccgaccgaccgaccgagctcgccggagccatggacgccggctacctgttcaaggaggagacctccctgtacaaccgcattgtcctcggcagcctcctgccggcctcggcctgggagccgatgccccggttactccagacctggctccgcaactacatcggcggaaccctaatttacttcctctccggcttcctctggtgcttctacatttattacctcaagcgcaatgtttacgtcccgaaggatgagattcctacgaggaaggcaatgttgctgcaaatatatgttgcaatgaaggcaatgccatggtactgtgctcttccaacactttccgaatacatggttgaaaatggatggacgaaatgcttttcaagaataagcgatgttggttggcttgcttacctagtgtacttgtcaatatatcttgtaatggcggagtttgggatatattggatgcacagagagctgcatgacattaaacccctttacaagcatcttcatgcaacacatcacatctacaataagcagaacacactttctccttttgccggcttggcgtttcatcctctagacgggatactgcaggcggtgccacatgttatggcactattccttgtgccaacccattttacaacgcacattgctctcctttttctcgaggccatatggacagcaaatatccatgactgcatccatggtaagctttggcctgtgatgggcgctggttatcacaccatccaccataccacctatcgccacaattatggtcactacaccatctggatggactggatgtttggaacactccgagaccccatagatgatggatccaagaaggagatgtaatttatgaagggtttcgtgccaattgttgtccaaattcttatttgacttgggtacttgaatttttatttgcgttgcttcttaatcgtagtacttgcttgtaaatgttggtccctattgagattgttcagcatcctggactagcaaagacttttaaagtagaagaggagatttatactacaaaaaaaaaa

SEQ ID NO: 85 - DNA, 1434 bp, Eucaluptus grandis
aaaacaatgaaaaacccacactcgctagcaagggaaaggtaagtgcttcactttcatgtgcttgtttcgattcgtactcaaaacaacaagcctagcggttccaccaccatggcacaccagcaactttgttcgcagtccgccatagcaggtactgaagagcatgagcggaaggagactgatgaactcattgcttcacttccccaaaggaaaggcgcggttcgtcctttccagtgcctttaccaaaacttttggagccccatcttcgtgcttcccaacgtgatcacgtttcaacggcactttgaagccaaacacaaggatattgttctggcctctcagcccaaatcagggaccacctggctaaaggccctagtgttttccatcgttaaccgcttccgcttcggcatctccaacacgcccttgctcacttcaaacccccatgaactcgttccattcttcgagttccagctgtacggaagtaaactgaggcccaaccttgatggcctggcagagccgaggctcttcgcaacgcacatcccttatccatccttgccggagtgcatcaagcggtctgaatgccaaatcatttacatttgccggaacccgttggacaccgtggtttcctcttggcacttcttccttgagaaggcgcgattagaagaccagccagagtggtcattggaagagcatttcgagacctattgccaagggacaatctcgttcgggcccttttgggatcacatcatggggtattggaagatgagcttggagtggccatccaaggtgttgttcctcaagtatgaggacctgaaggaggatactgtagtacacctgaatagggtggccgagtttgtgggtcttccctttactgaggaggaagaggaggcaggtgtgattgaagagatagccaaaatgtgtagcttgaagaccctaaaggacctagaggtcaacaaatccggcaaagtagccttgacgatcgagttcgagaagagaagcttttttaggaaaggggaggtgggtgattgggttaaccatctcactccttccatggtggatcgcctcaatagcatcatccaagaaaagatgagcccctttgggttggaattcaaaacgtgttgagcgttaaatactttcactttctctacttgtgtcactagaaataagtgaaattaataatggatctgcaatcttccttattgatgtagtatagagaacttaagaatccttgacttctctgtcgcaagagaagaaacaagtatttgaagctggtcaggtgtgaagaaaaaaaaggaagcattggtagcatcggtagactacatctatgctgtaaactattcctatcctataatagttgcatgtattgtctacgtgttcagtcaattagagatcatgtattcacaaatttactattaattcatcaacttttcaaaaaaaaaa

SEQ ID NO: 86 - DNA, 965 bp, Eucaluptus grandis
ctctcgtaccccccaccaccaaccatgcctgaatcccgtgaagactctgtctacctcgccaagctcgctgagcaggctgagcgttacgaagaaatggtcgagaacatgaagcgcgtcgcctcgtccgaccaggagctcaccgtcgaagagcgcaatctcctttccgtcgcatacaagaacgtcatcggcgcccgccgtgcatcgtggagaatagtatcctccatcgagcagaaggaggagtcgaagggcaatgaggcccaggtctccatgatcaagggctacagggagaagatcgagcaggagcttgcgaaaatctgcgaggacatcctcgaggtgctcgacaagcacctgatcccctctgcggcctcgggcgagtccaaggtcttctaccacaagatgatgggcgactaccaccgctaccttgccgaattcgcaaccggcgataagcggaaggacagcgctgacaagtcgcttgaggcctacaaggccgcatctgacgtcgccgtcaccgagctccccccgacacaccccatccgtcttggtctcgccctgaacttctccgtgttctactacgaaatcctcaactcgcccgaccgtgcatgccacctcgcaaagcaagcattcgacgacgccatcgccgagctcgacacgttatcagaagagagctacaaagactcgaccctgatcatgcaactgctccgggataacctgacgctctggacctcggacatgcaagactctgctgacaagcccgccgacacaaaggaggaggctggggatgcaccggcagaggattagatattgcacgcgctcgtttcttgttacccctcacttcatgccatgctacatcccccccttccgtacacgtcctccaatccaatgttatttcttattagcgctaagaccttacctctggatcccttcgttgaaaataatgaatccctttctgctctataaaaaaaaaa

SEQ ID NO: 87 - DNA, 1525 bp, Eucaluptus grandis
agcgtagttctttcccgcagctctctacttcgctcttcttctcaacccctgaagccaccatgagttcctcctcctccggcggcgacggcggcggcggcccgaagctccctcacgacgtcgccgtcgacatcctgaagcggttgccggcgagatccctcctccgatttaggtgcgtctgccgatcgtggcgttccgccatcgacgaccctcgtttcgtggccctccacttgagccactccgccctccacgcctccagtcggcatctcgcgtgtctagattgcggcgaagacgccgtccagaaccggtgctctctgttccccaacgcccctctcgccctgcctcctcccccgttgcaaatcgaaatcccgttcgttgctcctcccaaccgttacgccctcgtcggttcgtgtaacggtttgatctgcgtctcggagagttccagtgacggcactgagcgggcgctgtatttttggaatctattcaccaggaagcataaggcggttcggctcccccgtccggagcggatgccacccctctccgtggggggcgctcatgtagttctagggttttgtttcgatgcgaagtctaatgactatcgtgttgtcaggattatccgatacctaggtattcgccgtcgacgcttccgcaacaagaagcctcgagtcgaggtttattcgttccgtacagattcatggaagaccttggaatgtgaggttcctcttctctgtgacagtgcggtcttcttgaatgggaacctgcactggtattctttcaatggagagggggatggatacggatccatagtcttgttcaatgtcgcagatgaggtgtttgatgaaatagctctgccggaagggatcagtccccattttgtgttgtccgtggcggtattgaatgactcgctggctgtgttctttagtgatggggaggcttgtttcgtttgggttatgaaagactacggcgtgccagagtcttggagtaagctgtatactttcgaggttactggaccggtaacagcatttgatggctttacatggaatggcgagcttcttatggaaataaattgcgaagaacgagtttcttggaatccgatcacagcacaactctcaattcttccattattggcgagatacgaattgctccccgttgtagagagcctcgttccaccttagatatgactcgattgctgctatatcgtcaggtgcaaggtgctggagctcttctttattaacaggaattctggtgattggcaatgcaagtacagctggctctaacaaaaatgggggagtggcaaaggacagcagaaagtgatgttgaagtttcttcggaatatagtttacgtggaaggcaagaaacaatctgcttcatggttaagctacttctcccttcgagcatgttcttagattgatcgatttgaaggctatctactttcaaaaggatacatgttgtgcttatgattatctatataatgtaatgatggggatagtgaaaagctaaaatgtgtgagatttgcttaaaaaaaaaa

SEQ ID NO: 88 - DNA, 958 bp, Eucaluptus grandis
aagcaggctgcgagaatttcgaagtgctgtctgctcacatctctctctctctctctctcttctgcgaggcagtgcgatgccgtcccgccggagaacgctcctcaaggtcatcatcctcggggacagcggggtcgggaagacctctttgatgaaccaatatgtaaataaaaagttcagtaaccagtataaagcaactattggagctgatttcttgaccaaggaagttcagctcgacgataggctcttcactttacagatttgggatacagctggtcaagagagattccagagtcttggagtggctttctatcggggtgctgactgctgtgttcttgtgtatgatgttaatgttatgaagtcatttgacaatcttaacaattggagagaggagttcctcatccaggcaagtccatcagatccggagaatttcccatttgtggtcataggaaacaaaatcgatgtggatggtggaaacagcagagtggtatcagagaaaaaagctcgagcttggtgtgcttcaaaggggaatataccatattttgagacctctgcgaaggaaggtgtcaacgtggaggaagcttttcagtgcatagctaagaatgcgttgaaaagtggtgaagaagaagagatatacttgccagacaccatcgacgttgcaaacagcagtcagccaaggccatcaggatgcgagtgttaagaactgcccgatgcttcttcccaataaatgaatccatgaaggattactcagatattagcaggttctgcttgttttagatgatgctgggttgtacattgcttttgccagagaaaatggttgctgacagattcttttgtctggttccttccatttattgccgaatcaaatgcattcttgagtgatgtcctacttaatttgtctttcatgacgcggcttttctcatcagtgttgatttttgttggtgtaaaaaaaaaaaaaaaa

SEQ ID NO: 89 - DNA, 1383 bp, Eucaluptus grandis
gtgaagacgaaggaggagaaaaggtgagaaggagacataaggagaagaagaaaaggtgaaggaggaggagaaaaggtgaagaaggagaaggagaaggagaaggagaaaagttggtctcgagctgtaagggggtgaggtttttgaatggatcatcgagatagtggacctgattgctggtgaagtcgctgctccagttcaggtgtgtttccaaacagtggtgttgctcgatagacagcccttgcttcgtgatggcgcacctgaatcagttcgtcgggcggactgcaaacctctgcctctgcgtccagcaaaattcgagactaccgtatctatctggggtacccagcgtggaggatttgaagtaccgtctcatgggtcccagcgatcagatccgcgtgctggggtcttgtggccggctttgcatcatcgacgtggccgacgagatcaatgtatgggatccgtccactaggcaaagtatgccattgcctcactcagctgtcgagataaggcgtccatcggctttgcctatttgcgtttatggatttgggtgtgacgttaggaatggtgctttcaagttgttgaggctgattcagctcgctactgggcagagaagatccgaagtcagtatctataatatgatagatcaaaactggaggcggctcccggagatcgcttacaatctggtttatccggacaaaatgggggttttcgcgtacggccgtctgcatttaacagtgactccggagcggttggcatgttccccagcaaaattgctgttggcttttgattgtcacactgaggaatttgaggaggtggagctgcctgataatatagataaaaagcgtgacatggttgtggccgtcctggacgggcgcctttgcctcagcattgatagaattgacatgtttgccgatgtgtggattctgagagtatatggatcccaagaatcatgggcttgggtgttctcgatacctaaatatgatgatgataggattcctcgatttgtctggccattggcttgctccgaggatcatcatcacgttttggtgagaaaggacaataaggatgtcgtttggtatgatttacatgctaggtacatcaatagggtagatataaggggcatgccaagttcctttaaagatgcatatgtgatgtgattcacttgatcggaggaatcgtcgagaagcagcaagaattgaaagaggaaaatagggaccacaggaaagtactccgtgaatagtaggttcttttcttttggactgtctcagattcttcatagttagctcttttcttttggactgtctcaggttctcttctgggaagtggttctgtaatatatatatttgagcaaagaatagatgagatgattgagaactaaaaaaaaaa

SEQ ID NO: 90 - DNA, 1714 bp, Eucaluptus grandis
tcaatagaatcaacagatatgtaagccaggttacttcactcgtccagaatatataagagtgagcaagctttcaagaaacagaaagcacatacgattgaatacaccaatgggagcgtggttgggttgtattctggggctcatcccacttctaggctgctgcttgtggtggtggaatgagattcggtacgtgtggccagtaaagcgaagatgttcgggcaccaatgcgaagttgccgccgggacacatgggatttcccttctttggagaacttttcaccttcctctggtactacaagattctccgccgcccggacgagttcataaactctaaaagaaagaagtatggtgatggagtagggatgtacaggactcacctcttcggatcgccttccatcatagcatgcgttccatcagtgaataaatttgtcttccgagctgaggacacatttatcgctcaatggccgaatgtcgatattatgggcacgaattctctaggggcggttcacggaaaggcacatgacaggctcaggagctttgtcttgaatgccgttaaccgacctgatgctcttcgtcgtatagctgctttggtacagccgcgtttggtttctgccctcgagttgtgggcccaaaaaggcagaattgttgcttttcatgaaactaagaaggtgacctttgagaacatcgggaagctgtttgtgagctttgagccggggccacaattggaaaagatcgatgggttatttcatgacatgctcaaaggaatgagagctcagcggctcaattttcctggaactgcatatcgctgcgctctgcaggcccggaagaaggttgaggctatattcagagtagagctagaggaaaggaaaagccgaagtgaagaaactgtgaccgatcttatggatgagttacgacaaatcaaagatgaggaaggcagaaaactatctgaccaagaagtgctagataacatcgtcagctttgtgttcgccggttatgagtccacttcacttgcatcgatgtgggcaatttactatcttgccaagtctcccaatgttctaaagaaactccgggaagagaacacgtctgttagccaaaacaagaagggggagttcatcacgagtgaagacatctcgaacatgaaatatactaaaaaggtggtggaggagacactaagaatggccaatatttcacattttcttttcagattagtcacaaaggacatcgagtacaaaggttatagaataccaaagggatggaaagtgattctgtggctccggtacctccacacgaacccggaaaactttgatgacccaatgtgctttaatccagagaggtggaacgattctgtgaaaccggaggcataccaagtgtttggtgggggatcgagaatctgtccaggaaacatgcttgcgagaattcagctggctattttactgcatcacttatcagtagaatacaagtgggaattgatcaactcggatgcaggctttgtctatcttccccaccccgcaccagttgatgaagttgaagtcagtttcagcaagttatgaggaatgatttgttggaattttgtttgttaaaacaaaatgagtgccttttaatttgtcccacatagaaaatgtgggagcaggagggttagtttattaatgtaggatttcccttttatagttaaaagagtgattaggtggggttagacctcaccatgccaaaaaaaaaaa

SEQ ID NO: 91 - DNA, 1459 bp, Eucaluptus grandis
acaacgctcaagaagaaaatttcgaaacgatctctcgccctccgttccgctataaatagcacccgagcaccaatactctttccatcatcttcaaaacaactgtctctgtctctctctctgtccctctctctctctctctctcgattctctccctagtccattagttctcgttgccgcttcgtaaacaaggaagcacggcgcacggccgtccgatggttgtcccgtccaaactagcaattgaacagttctcctacgttatgaacagcaacgcattatcatcccaccaaatccctgtcgtggacctctcgaagcccgactccaagagcctcatcatcaaggcctgcgaagagtgcggcttctttaaggtcgtgaaccacggcgtcccgttggattttatctccaggctggaggaggaagccgtcaagttcttctctctgcctctccccgagaaggagagggcaggccctcctgacccgttcggctatggcaacaagatgattggccggaacggagatgtgggttggatcgaatacctcctcctgacgaccgatcccaacttcaactaccgcaagctcccatcggcttttaacgaaaacccagaaagatttcgctctgctttgagtgattacacatcggcggtgaggtacatggcgtgtgagattctcgagttgatggccgacggattaaggattcaacagaggaatatatttagcaaacttttgatggatgaacagagcgactctgttttcaggctcaaccactaccctccatgcccggagcttcaatcctatgtcgataggaacatgattggattcggtgaacacactgacccacaaatcatatctgttctcagatcgaacaacacgtctgggctccaaatatccatgaaagatgggacttgggtttctgttccaccggaccagaactcattcttcatcaatgttggtgactccttagaggtgatgactaacgggcgattcagaagcgtgaggcacagagtcctggcgaacacctcgaagtccagggtctcgatgatatacttcggaggaccacctttgagtgagaagatagcgccattgccgtgcctcatgaagggcaaagagagcctgtacaaggagtttacatggttcgaatacaagaagtccgcctacaacacgaggttggctgataacaggctagagcattttcagagagtagccgcttcttgatgtcgctcagagcgccagatgtcagcagcaagaatgggttcttaggacagcaactttcatcttcattttgttccttccttgtctctctgtattttccatcggtactttcttgttcaaacgatgtaaattactctcttcttgtcaaatatcacagagcgtccatggtctgccactatctctatttgacaatttgtaatatgtaattttcaatgaagtcacagtcacaagtcacctttcagacaaaaaaaaaa

SEQ ID NO: 92 - DNA, 1598 bp, Eucaluptus grandis
gacatttacagctctgagaaggagggtagggagtgagtgtggtgggcttttttttagcttcttgggagcagcaacaatggctgtttacatcttcttggctcttggggtggtgttggtgctctgtgtatgcactgccttgctgagatggaacgaggtaaggtacatgaagaaaggtctgcctccgggcacaatgggttggccagtctttggtgagaccaccgagttcctcaagcaaggccctaacttcatgaaaaaccagagtgccaggtatgggagcttcttcaagtcccacatcctggggtgccccacgatagtgtccatggacccagaggtgaaccggtacatcctgatgaacgaggccaaggggctcgtcccgggttacccgcagtccatgctcgatattctgggcaagcgcaacatagcggcggttcacggcgcgtcccacaagcacatgaggggtgctctgctctccctggtcagccccaccatgatcagggaccagctcttgcctaagatcgatcggttcatgcgatcccacctcgcccgctgggacgatggctccattattgacctccaagacaagaccaaacagatggcactcctctcgtcgctgatgcaaatcggaatcgactccagctccatttcccaagaattcatacccgagttcttcaagttagtcctgggcactctctccctgcctatagacctcccgggcacaaactaccgtcgaggtttccaggctaggaaaaatatactaggcatgttgaggaaactgatagaagagaggagggcctcccaggaagcccacaatgacatgcttggttgcctcatgaggagtgatgataacaaatacaagttgaatgatgaagagatcattgaccagataatcaccatcatgtattccgggtacgagaccgtttcgaccacgtccatgatggctgtcaagtatctccacgacaacccgagcgttcttcacgaattaaggaaagaacacttggggattagagcgaagaaaaggccggaggatcctatcgagtgggacgacctcaaagcgatgcggttcactcgtgcggtcatatttgagacctccagattggccacagttgtcaatggggtcttgagaaaaaccactaaagacatggagctcaacgggttcttaatcccaaagggatggaggatatacgtttacacgagagaaataaattacaatctgcgattatatcccgatccactagctttcaatccatggagatggctggacaaaagcgtggagtgtcaaaactacaacctaattttcggtgggggcacaaggcaatgccctggaaaggaacttgggattgccgaaatctccacatttcttcactactttgtgaccagatacagatgggaagagattgggggagacaagctaatgaaatttccaagagtagaagcaccaaatgggctgcacataagggtttcccctcaatgctgacttcactccaatattcttatgtacagaagaaaccaaaagaggaaaaaacaagaagcacgacaagtacagatgtatattaatgatttttgatagatttaagtaggaaagtgcaccaaaaaaaaaa

SEQ ID NO: 93 - DNA, 1157 bp, Pinus radiata
gggacacgatatcctcccatttagtcagcatgatgtgtcaagattaaaacccacagtgacggggctcacaagtatcttggcaaatttgatggatcccatttttcgttggtgcttcgtgtatgttttctttgtgagtggtagctgcaggagctgtgagtttcgatctcagttcgattaatttagccaaagaaaatgagtgccgagaaagagagggagagccatgttttcatggccaagttagccgagcaggccgagcgttacgatgagatggtgcagtcaatgaaggatgttgccaaattggatctagagctgtctgtagaggaaagaaacttgctttctgttggatataagaatgttattggtgccaggagagcatcatggcggattatgtcctccattgagcagaaagaagaagcaaagggaaatgagcagaacgcgaaaaggatcagggattaccgtcaaaaggtggaggatgaactctgtagaatctgcaatgacattctgtcaattattgatgatcatctccttccttcttctacctcaggagagtccacagtcttttactataagatgaaaggcgattactaccgatatcttgctgaatttaaatctggaaatgaaaggaaggagattgctgatcaatctttgaaggcttacgaggctgcttcaaatactgcagctacagatctgcctcccacacatccaatcaggcttggcttagcactaaacttttcagttttctattatgaaattcagaactctcctgaaagagcatgtcacttggcaaaacaagcatttgatgaagccattgcagagctggatactctcagtgaagaatcatacaaggacagcacattaataatgcaattgctgagagacaatcttacattatggagttctgatttggaagatcttggaggggatgatcagcctaaaggagaagaggcgaaggtggaagatggggaaccctaattttgttgcaatagcgtttcttcggcagttggattgcttggaggatttttgatattcttcctggcgtacttcctcagtcttttttgttttgagtggatgtttatatcactttgatgcaatacagtttcacttgcattgtgagttttttttttctagattgacatccttcgttggttctcaaagta

SEQ ID NO: 94 - DNA, 875 bp, Pinus radiata
gagagcaggttgaggagggcgtaagttaaatcagcctagatctcttcgactccatcttcattcaacataagctcgaactcatcatgtcggcccgcagaagaactcttttaaaggttatcatccttggcgatagcggggttggtaaaacctcgctgatgaatcaatatgtaaacaagaaattcagcaaccagtataaagcaaccattggagctgacttcttgactaaagaagttcagttcgaggatagattgttcacgttacaggaaagatttcagagccttggtgttgccttctaccgtggtgccgattgctgcgttcttgtttacgatgttaatgtgctaaaatcatttgataacctaaataattggcgcgatgaatttctaattcaggcaagcccttctgatccggagaattttccatttgttgtgcttggaaataaaattgacgtggatggtgggaacagcagagtggtctctgagaaaaaggccagggcatggtgtgcttctaaaggcaacattccctactttgaaacttctgcaaaagaaggctttaatgttgaagcagctttccaatgtatagccaagaatgcattgaagaatgagcccgaagaggaaatatatctcccggacacaattgatgtcaatgctgggagaccacaaagaacatcaggatgtgattgttagtcaccaggggattgtacaagactttgatgctacaaataatagtttacttgcatcgtaagatatcgaacttgaatcaggccattggggtgttaatcaaacgtttacttgtgtaaccagtgtagagatagaattgtactctagtaatgctcattaaaagttagattgttgttttgcaatttcgcaaaaaaaaaa

SEQ ID NO: 95 - DNA, 971 bp, Pinus radiata
cattccccaatcccctttttactttttgcggaacagggaccgggggcagcgatctattgaccagagaccagagagcaggttgaggagggcgtaagttaaatcagcctagatctcttcgactccatcttcattcaacataagctcgaactcatcatgtcggcccgcagaagaactcttttaaaggttatcatccttggcgatagcggggttggtaaaacctcgctgatgaatcaatatgtaaacaagaaattcagcaaccagtataaagcaaccattggagctgacttcttgactaaagaagttcagttcgaggatagattgttcacgttacagatatgggataccgctggccaggaaagatttcagagccttggtgttgccttctaccgtggtgccgattgctgcgttcttgtttacgatgttaatgtgctaaaatcatttgataacctaaataattggcgcgatgaatttctaattcaggcaagcccttctgatccggagaattttccatttgttgtgcttggaaataaaattgacgtggatggtgggaacagcagagtggtctctgagaaaaaggccagggcatggtgtgcttctaaaggcaacattccctactttgaaacttctgcaaaagaaggctttaatgttgaagcagctttccaatgtatagccaagaatgcattgaagaatgagcccgaagaggaaatatatctcccggacacaattgatgtcaatgctgggagaccacaaagaacatcaggatgtgattgttagtcaccaggggattgtacaagactttgatgctacaaataatagtttacttgcatcgtaagatatcgaacttgaatcaggccattggggtgttaatcaaacgtttacttgtgtaaccagtgtagagatagaattgtactctagtaatgctcattaaaagttagattgttgttttgcaatttcgcaaaaaaaaaaaaaaa

SEQ ID NO: 96 - DNA, 2672 bp, Pinus radiata
aagcggtggtatcagcgcagagtacgcggggactccttatattgtctctctgtgttgaatgctgtgaccatgaagcgggcgagctatggatgcatatcggacgaagccctggagtgcgttatgggccacctggaggatccgagagaccgtggctcggtctctctggtctgcaagaaatggtacgacgtggatgccttcacgaggaagcacgtgaccgtggccttctgctactcaatacacgccagcgaccttacccgcaggttcaccaggctggagtcccttacggtcaaggggaaacccagagcggccatgtataatctgctccctcacgattgggggggttatgccaagccctggatagaccagatctccttcacctgtctctgcctcaaggcgctccatctgcgcagaatgattgttaccgatgatgatctcaccactctcgtcaggggccgcggtcacatgttgcaggagctcaaactcgagaagtgctctgggttctctacaagggggcttgaggaagtggctcacggttgcaggtctcttaagatcttaatgctggacgagagtcaaattgaagaggaaagcggggactggctacatgagcttgctcttaacaattcttctttggaagtgttggacttctacatgacaacattagaaatgatcaataccagtgatcttgagctaatagtaacaaactgcccctcattaacatcattaaaggttggagaatgtgatatagttgagatgagaggcgttctgagtaaggctactgcattggaggagtttggtggtgggacatttaacaacagtgaagagcatgcgacggagaccagtatgattacatttcctccaaagttgacatcattgctaggactaaacttcatgattgaggctgagatgcctgctatattcccaagagcttcggcccttaagagattggatctgcagtacacattcttgagcacagaaaatcactgtcagttggcagggctctgtcctaatcttgaaattctcgaggttagaaatgttatcggagacaaagggttagaagttgttgctaatacttgcaaaaagctgaaaagacttagagtggaacgaggagcagacgacccaactttggaggacgaacaagataaagaagagcacatcgctgatttaccgctggacaatggagtcagggctttgctacgtggatgtcaaaagttgagtaggtttgcattttatatcaggcctggagggctgacagatacaggtcttggttatattggcgagtacagcactaatgtaaggtggatgcttctgggttttgttggtgaaactgaccaaggcattctcgagttttccaagggctgcccaaagctggaaaggctagaaattagaggttgttgttttagtgaatctgcattggcagctgcagtgcttcagctgaaatcgctgaagtacatatgggttcaaggatataatgcaactgttactggtgctaaccttctagcgatggctcgaccttattggaacatagaattttctcctgctttgcaatcgagtgatgtgtttgctgaagatatggcagaagaaaaaaaacaggatcaggtagcacaacttttggcctactattctcttgctggaaggaggacagatcacccagagtccgtaattcctttagctccacttttctggaattgccatcaagtaactgtcttctaatgtgaatatctatataaaatatgagtcccaaacttgcatggaggtatataaatatagaacatgcaaagatgcttctttctctcccgtttccttcagatttcttttgtgatagtagtgtgactagcacttactatgcctaacagtctgatggaagaaaggtacgttgagacttatctctcttcctaattctctatggcagtggatgtagtcattctacctcataacgtgtctgtttattgatggaaacttcttcccagtgtgatgaactcttctggagagttctaggggatgtcttggtaggttcaatgggatgtcttctgaatatcataatcttcatatttctatcaatgaagacattgctgaaagaagtggttaccacaaaaatccatgtaagtacaaggggtattgcactgacaaaaaaaagttcgtccttggaaaactgaaatgtttattttttcttctaagctggttacggatatttatggagttgagatgtacgtaatcgcgaaggtgtacagtcaaaacgggtatgtttcatactttgacttggtgggctacaagtcaaaacttacagtggacataccgtgcttcttttcctagtatgctggtaacatcagtgctgaagtcaacaggcctctggttttcaacgacattaagttgtgggtatgcttaaggacatcgaaataccaagggcactagagttcaagtagacgtttataatttaaccggccattcaacatcctgagtttgtagcatgagaagccacttgtcttattttcagttcttggtagggagttcagaattagggggtgatttgagaacatcataaataatgtcatattttatatccagagacttgaactatttgtatgttgtaattcatattggttgacatgattgatatgtacatatgttacatggtattagcatgaggatgttgatgtttgaccttaaaaaaaaaa

SEQ ID NO: 97 - DNA, 3083 bp, Pinus radiata
gccgtcggatccactccccggcggccacgatcggtttgctttcccttttgtcgtctgacaccttttcccgacctacaggaagcatagatttttactgtaagatgcgatgagtgagcaatgagcgatgggcatgtcgcaaaattagagataagatcaccaaggaaccaacaaaatcagaggccgaggacctcgaccaggggctctctgtgtatatagctttgaagtccatatgaatatattcactccttatattgtctctctgtgttgaatgctgtgaccatgaagcgggcgagctatggatgcatatcggatggatgcatatcggacgaagccctggagtgcgttatgggccacctggaggatccgagagaccgtggctcggtctctctggtctgcaagaaatggtacgacgtggatgccttcacgaggaagcacgtgaccgtggccttctgctactcaatacacgccagcgaccttacccgcaggttcaccaggctggagtcccttacggtcaaggggaaacccagagcggccatgtataatctgctccctcacgattgggggggttatgccaagccctggatagaccagatctccttcacctgtctctgcctcaaggcgctccatctgcgcagaatgattgttaccgatgatgatctcaccactctcgtcaggggccgcggtcacatgttgcaggagctcaaactcgagaagtgctctgggttctctacaagggggcttgaggaagtggctcacggttgcaggtctcttaagatcttaatgctggacgagagtcaaattgaagaggaaagcggggactggctacatgagcttgctcttaacaattcttctttggaagtgttggacttctacatgacaacattagaaatgatcaataccagtgatcttgagctaatagtaacaaactgcccctcattaacatcattaaaggttggagaatgtgatatagttgagatgagaggcgttctgagtaaggctactgcattggaggagtttggtggtgggacatttaacaacagtgaagagcatgcgacggagaccagtatgattacatttcctccaaagttgacatcattgctaggactaaacttcatgattgaggctgagatgcctgctatattcccaagagcttcggcccttaagagattggatctgcagtacacattcttgagcacagaaaatcactgtcagttggcagggctctgtcctaatcttgaaattctcgaggttagaaatgttatcggagacaaagggttagaagttgttgctaatacttgcaaaaagctgaaaagacttagagtggaacgaggagcagacgacccaactttggaggacgaacaaggttggatttcccacaaagggctttccttggtagctcaaggctgcccccttcttgagtacattgccgtctatgtttcagatatatgcaactcaaccttggagacctttggtcaatgttgcaaaaatctcaaggatttccggttggtcttgttagataaagaagagcacatcgctgatttaccgctggacaatggagtcagggctttgctacgtggatgtcaaaagttgagtaggtttgcattttatatcaggcctggagggctgacagatacaggtcttggttatattggcgagtacagcactaatgtaaggtggatgcttctgggttttgttggtgaaactgaccaaggcattctcgagttttccaagggctgcccaaagctggaaaggctagaaattagaggttgttgttttagtgaatctgcattggcagctgcagtgcttcagctgaaatcgctgaagtacatatgggttcaaggatataatgcaactgttactggtgctaaccttctagcgatggctcgaccttattggaacatagaattttctcctgctttgcaatcgagtgatgtgtttgctgaagatatggcagaagaaaaaaaacaggatcaggtagcacaacttttggcctactattctcttgctggaaggaggacagatcacccagagtccgtaattcctttagctccacttttctggaattgccatcaagtaactgtcttctaatgtgaatatctatataaaatatgagtcccaaacttgcatggaggtatataaatatagaacatgcaaagatgcttctttctctcccgtttccttcagatttcttttgtgatagtagtgtgactagcacttactatgcctaacagtctgatggaagaaaggtacgttgagacttatctctcttcctaattctctatggcagtggatgtagtcattctacctcataacgtgtctgtttattgatggaaacttcttcccagtgtgatgaactcttctggagagttctaggggatgtcttggtaggttcaatgggatgtcttctgaatatcataatcttcatatttctatcaatgaagacattgctgaaagaagtggttaccacaaaaatccatgtaagtacaaggggtattgcactgacaaaaaaaagttcgtccttggaaaactgaaatgtttattttttcttctaagctggttacggatatttatggagttgagatgtacgtaatcgcgaaggtgtacagtcaaaacgggtatgtttcatactttgacttggtgggctacaagtcaaaacttacagtggacataccgtgcttcttttcctagtatgctggtaacatcagtgctgaagtcaacaggcctctggttttcaacgacattaagttgtgggtatgcttaaggacattgaaataccaagggcactagagttcaagtagacgtttataatttaaccggccattcaacatcctgagtttgtagcatgagaagccacttgtcttattttcagttcttggtagggagttcagaattagggggtgatttgagaacatcataaataatgtcatattttatatccagagacttgaactatttgtatgttgtaattcatattggttgacatgattgatatgtacatatgttacatggtattagcatgaggatgttgatgtttgaccttatttaagtgttcgtaggttgtaattaaaaaaaaaaaaaaaaaa

SEQ ID NO: 98 - DNA, 1025 bp, Pinus radiata
attatctcatcacaaaaatctttaatttgctctttgaaccattctgcatcatgtttacaataagtacctgtacaactcacgcacaatctctgatatacagttttgttgcgaggggcaccgtggtgcttgcggagtacacggaattcaaaggcaattttacaggtattgccgctcagtgtctgcaaaagcttcccgccagcaacaacaagttcacatacaattgcgataatcataccttcaactaccttgttgaagatggcttcgcatattgtgttgttgcagatgaatccgttggaaggcaagtaccaatggcatttctggagcgtgttaaggaggattttaagaggagatatggtggtggaagagctgacacagctgttgctaacagcttgaacagagattttgggtcaaaattgaaagagcacatgcagtattgcattgaccaccctgaagagatcagcaaacttgcaaaagtcaaggcccaggtttctgaagtgaaaggtgtcatgatggacaacattgaaaaggttcttgaccgtggtgagaagattgaacttctggttgataaaacagaaaaccttcgttttcaggctcaagacttccaaaagaagggaaccgagttgcgcagaaagatgtggtttcagaacatgaaagtgaaattgattgtccttggaattgtggtggccttgattctcataattgtcctttcagtatgccatggattcaattgttcgaaaaaatgatctggaatagatagaggtccatttgaattggaacaacttttgattggctatggatggcattcttgttctcctttgtatttctctctatattatcagtttcgggtgagatagttctatgatgtttgccagagggtattttgcttggacaatcactggttgatagtacatattgactagtatgacaacgaaatgttctgaatattcagtggggcagagactctgattgcgtacagcaactttagtgtattatatcaaggtcatgcatttgttataaaaaaaaaa

SEQ ID NO: 99 - DNA, 1505 bp, Pinus radiata
cccaaattaaaagtcgagcgcttaatgaaatgatagtcgtcagatgacgtccgaggggtttcaaataattcttagccgtccatttcgtagaacatcggtactccatcaattttcctgctcatcttaccctcattttgtaattctcttcctggcggagggtttggaagctggggaaatcaggcgaaataaatagggaattgggactgtttgctgcaaatatcgtttttattcgccgaaaatcagctttgggtctgtgatttggccttctgcgttcgattctgcgcgttttcagcttcatttccaaggccttttcgtcaggtttggctaaaaaatgaccaccgaaaaggagagggaaaatcatgtatacatggccaagctcgccgaacaggccgaacgatacgacgaaatggtggattcaatgaagaaagtggccaaattagacgttgaactgacagtcgaagaaagaaatctgctttctgttggctataagaatgttattggtgctaggagggcttcctggcggattatgtcgtccattgaacaaaaagaggagggtaagggtaatgacgtgaatgcaaagcgaatcaaggattatcgtcacaaagttgagacagagctgtctagaatctgtggagacattttaaccattattgatgaacatcttattccatcttctagctctggagagtctatggtcttctattacaagatgaaaggagattactatcgttatcttgctgaatttaaaagtggtagtgataggaaagaaactgctgatcaggccctcaaagcatacctggctgcttcaaccactgcaacaacagatttgcctccaactcatcccatcaggcttggccttattctgaatttctcagtgttctattatgaaattcttaactctcctgagagagcatgtcacttggccaaacaagcgtttgatgaagcaattgcagaacttgattctcttagtgaagagtcgtacaaggatagcacattaataatgcagctactaagagacaatcttaccctttggacttcagatttgcaagaagatggaggagaagagcagctcaaaggtgaagagattaagccagaagatggagagcattaacactaaaaggggagcagaacgagtttatgcatgagaagctatgatcccatggttattagggtgtaggtcattatttaattggtagttctttcacattttctgctgctttggagatgtagatattacttcagcccatttggttatatgggattgaattttagctgatttggcattggacttgtttagctatataggttcagatgtataaaactttctattctgggatctaggttttttcggctggaactcgggtgtatctctttggggattaaatctgcatccgaaggtgttgtccaattttaaaacaaagaccacatcgtatagtttatatatttgaatgtgattactgttgaagcatcaaaaaaaaaaaaaaaaaaaaaaaaaaaaaaaaaaa

SEQ ID NO: 100 - DNA, 1201 bp, Pinus radiata
gggtatatagaggaaaaggcaagctttctgtttcaaagggaagatgagttcaagggagagaaaagcgagggtgggtttgaagctgccaatcccagctcgggaagacgcatttgctaaaccaatgccattgccgcttccactgccgaagcctcctaacatgaatggtgcctgcaagttgccctgcgttcctcttgaagaagttacactggaagatctccagaagatttcaactttggggtgtgggagcagtggtaaagtgtacaaggttaagcatgccaagactgggaaaatttatgccctcaaaatcattcaggaaaagcacgagcttgctgtccgaaagcaaataatgagggaaatggagattctccgaagggcgaattctccacacatcgtgcagtgttatggcatattcgatcgaggaggagagatctcgtttgtgttggagtacatggacggtggaacccttgcgcaggttcttcaagcccacaagaaaatcccagaacactatttggctgaggttgccagacaggtgctgaagggcttgcattacctgcaccagaacaaaattgttcaccgtgatataaagccctccaatttgctgatcaacaagagaagagaagtgaagattgccgatttcggtgtcagcactgtgttggctcacactttggcccagtgtaattccttcgtgggtacttgtgcttatatgagtcctgaaaggttcgatcctgatgggtacggtggaaagtatgatggatgctctgcagatatatggagcttgggattatctttgctggaatgtgcgcttggaaggttcccttgtttgtctccggggcagaggcctgattggcctactttaatggtggccatctgtttgggcgaccctccatccccgccacctgatgcatcgccagagtttcagagttttatcagatgttgccttcaaaaggatgcgttacttcgccatactgcacatcggctgctttcgcatccttttttgaagaagtatgaacagcaatcttgtgacctggctcccctcctgcagtctttacacttgtagaattttgaattcctttttgtattttgaatattgtacctgagagcattcattgacttgtaatgaatgtacactctcttggtctctggaactctattttgtaaatcattttgcaatgcaactgcagtcttctttacaaaaaaaaaa

SEQ ID NO: 101 - DNA, 1641 bp, Pinus radiata
aaaaggtttccatctagaccgtccataccctcacagggacgacgcacggggtgacgtggaacacctggttcggctgacacgtgtcagcaatgttcatagcatgaccggctacaaaagggactcattgatctttcagaagaattgagcttttcttattggggagcgagaggtgaattcgttcacaaatcatcgtctggtctgcgattggacttttgcgatcattaaattgtcagctacggatcttcgttctcactcctctgttgatccaaaagctgcggagcccggcaatctgcagaaatttttttgaagaatttgagtttttgagaccggctatctgcagagaaaaattcgaagaatttgagtgccagcatcgaatccccggactgaatggcgaccactggcaccaataacatgcaggctaagctggtgcttcttggtgatatgggtactggaaaatcgagccttgttttgcgatttgtcaaaggccaatttttggattatcaggagtcgacaattggagcagcatttttctcacagacactagcagtgaatgaggtgactgtaaaatttgagatatgggacactgcaggacaggaaagatatcatagcttggcgcccatgtattataggggtgcggcagcagctataattgtttatgacataacaaatttggattcttttgtccgagcaaagaattgggtgctggagcttcaaaaacaagggaacccaaatttggttatggcccttgctggaaataaggctgatatggcagcaaagaggaaggtcgaaccagaggaagctgaaacatatgcaaaggaaaatggtctatttttcatggaaacctcagcaaagacggcgcagaatgtcaatgaactgttctatgaaattgcgcgaagattacctaaagcccgaccagtgcagcagcctgcaggcatggttctcacagatagacctgcagagagtgctaaaacttactcttgctgctcataagccctcgatttcgtgtcactgaaaatttgaagatgccaccttcagctgtaagcagttattctatgcacattatttgctacggctgtgatatccggaggagatggtgggggggggttcaagctttgtttagaacttgctttaaggaattttagcgtttatggagaaatgtaaaaatacatattttggtgcttaaattatatctctgtagtgagttgcgatggtcattgaaagccttctgatacaactctttggtgccatttatgatgagcttatatttaaattgaaaagctgtgctctgtttaaatactccgagctcggagagggtagatctcttttgatcctgcaatgacctcttgtgtttgattgattgtactagactatactatgggacgcctaacctgtcatttaaaaatgtgagactgttcgtaacaaagtcttgctattgctaccttgcattgaaactaatgttttcttgaagcatgatgaataaattggctaatagtgtagtcgttctgaagaaaaaaaaaattcttcaatggtagaattggatatttgtgatctttgaacttggaattgatatgatcagtcattgtgtattatatttctttctcagaggatgataatcggttgaatttgaatataaatctctcc

SEQ ID NO: 102 - DNA, 1699 bp, Pinus radiata
gaaagaagaagagtacaacatcacaaaaggccaaagagcaggtcgaggctgctcccactgaaatctttcgccattcgactgttagaaagcacaacaaagcagtcgtcagcttttgaataccaattccgtgggcgatcggaatcctccctgcccctgcatcctttcggcagctcgcggaataacaagcctctgcaggtttggggttcttggatgcagaattagaagacagcgccatggaaacgggcgctgcggcagtagacggtcacatacagggaattctgacccatggcggtcagtatgtgcagtataatatatttgggaacctcttcgaggtcttctccaagtacataccccccatacgacctatcggccgcggcgcatatggcattgtttgctcggcagtgaactcggagacaaatgaggaagttgcaattaagaaaattggcaatgcttttgataacagaattgatgcaaagaggactcttcgcgaaattaagcttctatgccatatggaacatgaaaatatcattgcaattaaagacatcattcggccacctcagagagaaatttttaatgatgtttatattgtatatgagctcatggatacagatctctaccagattatacgctccactcaaccattaacagaggatcactgtcagtacttcctatatcaactattgagagggctgaagtacatacactcagcaaacattctgcatagagatttaaaacccagtaatttgcttctaaatgcaaactgtgacctaaaaatatgtgattttgggcttgcacggactacttcagaaacggactttatgacagagtatgttgttactcgctggtatcgtgcaccggaactactattgaattgttccgagtatacagcagccattgatatctggtcagtgggctgcatttttatggagatactaaagcgggagcccttgtttcctggtaaagattatgttcagcaattaaggctcatcactgagttaattggttcaccagatgactctgatcttggctttttacggagtgacaatgctagaagatacatcaggcaacttccacagtttcctaagcaacctttttctcagaaattccccaacatggctccagcagctgtagatttacttgaaaaaatgcttgtatttgatccaagcaaacgcattacagttcaagaggccttgagtcacccttacttggcaagtctgcatgacatcaatgatgaacccagctgccccactcctttcaactttgattttgagcagccctcattcaccgaggaacatataaaagagctcatttggagggaatctcttaacttcaacccagacatgatgcaatagctggagcagatgggcttgatatttatcttgtaattcctccttactggttatgttattatgcttctgcaaggcaatccttctcttggtttgttattgccttctgaaggtttgcagatcattgtgcaggtgtggaaacttgttttattagagttaggtttgcttttattctttgaaggtctggtaaaagaaaaggaattgatggatatgcttacagatcattgtgaaaattgtgtattcctaatctgagccaactattggcctctactttattatcattggacattaaaatgtaactgggaaacttaataatctaaagtaaatgctgaaggaatttgttaaaaaaaaaa

SEQ ID NO: 103 - DNA, 780 bp, Pinus radiata
ggttttaaaatcgtggcatatgcgggtgacagaacaaccagaagattacctcttcaaaattgttttaataggcgactctgctgtgggaaaatccaatctacttgcaagatatgcccggaacgagttctatcccaattccaaatccacgatcggagtggagtttcagacacagaccatggaaatcgatggtaaagagatcaaagcacagatctgggacacggccggccaggagcgcttcagggccgtgacctcggcatattacagaggagccgtgggagctcttgtcgtgtatgacatcagtcggcgccagacattcgacaatatttctcggtggctcgatgagctgcacacgcattctgatatgaatgtggttacagtaatagttggcaacaaaaccgacctaatggatgccagagaagtttctacagaagaaggagcagcattggcagaggctcagaacttatattttgtagagacctcagcactggattctacaaatgtccaagtagcttttcaaacagttgtcaaagaaatttacaacattctgagtaggaaagtattgtcatgtcaggaacagaaacttgaatcaaaattaactaatggaaaaacagtcattttgcatgaagcagaaagtgaatctaccacgaaacaaactggaaagttctggtgttgttctggttagctttgtttatttcaatactttccaaggggttcgcaaggtcttttgcaatgtctagccagattattccatgtgaaagaattcttaaaagtgtgatgcgg

SEQ ID NO: 104 - DNA, 1037 bp, Pinus radiata
ctgaatggtgtttttcggatcttaaacataaattcattatcaactgcatttcaaaagctcggtttcttccgtagtattcttgcctccgtcgaggcctgaatcggtcgattgtggttattgaagatacattttaggttttaaaatgatgtcatatgcgggtgaagaacaaccagaagattacctcttcaaaattgttttaataggcgactctgctgtgggaaaatccaatctacttgcaagatatgcccggaacgagttctatcccaattccaaatccacgatcggagtggagtttcagacacagaccatggaaatcgatggtaaagagatcaaagcacagatctgggacacggccggccaggagcgcttcagggccgtgacctcggcatattacagaggagccgtgggagctcttgtcgtgtatgacatcagtcggcgccagacattcgacaatatttctcggtggctcgatgagctgcacacgcattctgatatgaatgtggttacagtaatagttggcaacaaaaccgacctaatggatgccagagaagtttctacagaagaaggagcagcattggcagaggctcagaacttatattttgtagagacctcagcactggattctacaaatgtccaagtagcttttcaaacagttgtcaaagaaatttacaacattctgagtaggaaagtattgtcatgtcaggaacagaaacttgaatcaaaattaactaatggaaaaacagtcattttgcatgaagcagaaagtgaatctaccacgaaacaaactggaaagttctggtgttgttctggttagctttgtttatttcaatactttccaaggggttcgcaaggtcttttgcaatgtctagccagattattccatgtgaaagaattcttaaaagtgtgatgcggtaggaagttttgctctactactggttatacagcagcttgaaacaaaacttgggaattctcatttttggctggttttgaagcaatttcagattgaagggaaatgctgattcatagcaaaaaaaaaa

SEQ ID NO: 105 - DNA, 1358 bp, Pinus radiata
acacgaaaaaccaaaaggttgctctaacattgaatgaaaatccattgctcaactgctcatttaaatgaggatgcatcacactactgtgcctgatctgtatcgggaacccatttgagtagatttgaaatatacataactaacccatttgagtagatttgaaatatacataactagcgacaagtcaaatctcgttatcttctgaccatcttctcgatttccctgaaggaagcttggattatggcgactcggaaacggacattgctgaaggtcatcattctgggcgatagcggggtggggaaaacatcactaatgaatcaatatgtgaataagaaattcagcaaccaatacaaggcaacaattggagcagatttcctgaccaaagaagtgcaagtggaagacagacttgtgacaatgcagatctgggatacagctgggcaggagcgttttcagagtttaggtgttgccttttatcggggtgcagactgttgtgtccttgtctatgatgtgaatgttataaaatcatttgataatctggacaactggcaccaggaattccttatacaggcaaatcctaatgatccagataatttcccatttgtggtattgggaaataaaactgatgttgatggtggtcatagcagagtagtgtctgagaagaaggcaaagatgtggtgtgcagccaaaggaaacattccatattttgaaacatcagctaaagaggacatgaatgtggaggaagcttttcagtgcattgctaagaatgcattaaaaaatgagccagatgaggaaatttatctgccagagactatagatgtgggtcacatcggtgtacagaggccatctgcatgccagtgttgaagatccatgagtaaatgaggtaaatatggacaaggtgccagataatttttacatgtctagctggttggtaacaatggtattattcttgtaccagaatgtgaaatttttggtaattcttgattcaagaatcagattggagaaacttatatatggtttggattctggaatattcattataatgggacctatgcactaagattgaatattccccttcaagagagttaagggatgcctacagtaagtttcttgtggtgagctaaaacgaagttgtaactgcagtcttcagaaaaggctgtatcaatccggtcttaaccagacagctcaaaagtgtctgaattagcttgtgtttattcatgctctctgtattcgtattttccaatgcattatatatgctctcttgtaatagctaccctgctttcacttggatactgttcgctgttaatgcttgaaatttaatataaatttctcacctctgtttgtccatgactccaaaaaaaaaa

SEQ ID NO: 106 - DNA, 1306 bp, Pinus radiata
ggttgctctaacattgaatgaaaatccattgctcaactgctcatttaaatgaggatgcatcacactactgtgcctgatctgtatcgggaacccatttgagtagatttgaaatatacataactagcgacaagtcaaatctcgttatcttctgaccatcttctcgatttccctgaagatactggtctgaaattgaaggaagcttgggattatggcgactcggaaacggacattgctgaaggtcatcattctgggcgatagcggggtggggaaaacatcactaatgaatcaatatgtgaataagaaattcagcaaccaatacaaggcaacaattggagcagatttcctgaccaaagaagtgcaagtggaagacagacttgtgacaatgcagatctgggatacagctgggcaggagcgttttcagagtttaggtgttgccttttatcggggtgcagactgttgtgtccttgtctatgatgtgaatgttataaaatcatttgataatctggacaactggcgccaggaattccttatacaggcaaatcctaatgatccagataatttcccatttgtggtattgggaaataaaactgatgttgatggtggtcatagcagagtagtgtctgagaagaaggcaaagatgtggtgtgcagccaaaggaaacattccatattttgaaacatcagctaaagaggacatgaatgtggaggaagcttttcagtgcattgctaagaatgcattaaaaaatgagccagatgaggaaatttatctgccagagactatagatgtgggtcacatcggtgtacagaggccatctgcatgccagtgttgaagatccatgagtaaatgaggtgccagataatttttacatgtctagctggttggtaacaatggtattattcttgtaccagaatgtgaaatttttggtaattcttgattcaagaatcagattggagaaacttatatatggtttggattcgggaatattcattataatgggccctatgcactaagattgaatattccccttcaagagagttaagggatgcctccagtaagttttttgtggtgagctaaaacgaagttgtaactgcagtcttcagaaaaggctgtatcaatccggttttacccagacagctcaaaagtgtctgaattagcttgtgtttattcatgctctcggtattcgtattttccaatgcataatatatgctctcttgtaatagctaccctgctttcacttggatactgttcgctgttaatgcttgaaatttaatataaatttctcccctctgtttgtccaaaaaaaaaa

SEQ ID NO: 107 - DNA, 1639 bp, Pinus radiata
gcaatattttaaaaaagatgaacagtgagataaaatgaataattgcttctcatgaatccgagcagctgaattgtgcaagggacatgtgcttgctcaatataattttattattgttcttccataaaggctctcacgagccaaaagaaacacgaaaaaccaaaaggttgctctaacattgaatgaaaatccattgctcaactgctcatttaaatgaggatgcatcacactactgtgcctgatctgtatcgggaacccatttgagtagatttgaaatatacataactaacccatttgagtagatttgaaatatacataactagcgacaagtcaaatctcgttatcttctgaccatcttctcgatttccctgaaggttctcgcattttcttcttctctaggatcatttattaactcagttgtcatccacatttgattgctgatactgtgcatggttctgagaatctcagaattgacaattgggtatgtatatactggtctgaaattgaaggaagcttggattatggcgactcggaaacggacattgctgaaggtcatcattctgggcgatagcggggtggggaaaacatcactaatgaatcaatatgtgaataagaaattcagcaaccaatacaaggcaacaattggagcagatttcctgaccaaagaagtgcaagtggaagacagacttgtgacaatgcagatctgggatacagctgggcaggagcgttttcagagtttaggtgttgccttttatcggggtgcagactgttgtgtccttgtctatgatgtgaatgttataaaatcatttgataatctggacaactggcgccaggaattccttatacaggcaaatcctaatgatccagataatttcccatttgtggtattgggaaataaaactgatgttgatggtggtcatagcagagtagtgtctgagaagaaggcaaagatgtggtgtgcagccaaaggaaacattccatattttgaaacatcagctaaagaggacatgaatgtggaggaagcttttcagtgcattgctaagaatgcattaaaaaatgagccagatgaggaaatttatctgccagagactatagatgtgggtcacatcggtgtacagaggccatctgcatgccagtgttgaagatccatgagtaaatgaggtaaatatggacaaggtgccagataatttttacatgtctagctggttggtaacaatggtattattcttgtaccagaatgtgaaatttttggtaattcttgattcaagaatcagattggagaaacttatatatggtttggattctggaatattcattataatgggacctatgcactaagattgaatattccccttcaagagagttaagggatgcctacagtaagtttcttgtggtgagctaaaacgaagttgtaactgcagtcttcagaaaaggctgtatcaatccggtcttaaccagacagctcaaaagtgtctgaattagcttgtgtttattcatgctctctgtattcgtattttccaatgcattatatatgctctcttgtaatagctaccctgctttcacttggatactgttcgctgttaatgcttgaaatttaatataaatttctcacctcggtttgtccaaaagaaaaaaaaaaaaa

SEQ ID NO: 108 - DNA, 2552 bp, Pinus radiata
ggcgatacgaggcagccagctttttacacctgttgattggagagcccaaacagaaaatagccaaacacccgatgcattcgcaggtcgtggggaattcgtgagtggaggaaatcgatccactctctatatgtaaatcgctatcacacacatcgcactctgcgaaaaagggagaatttttttccttcaaaacgagatgaagatgggttaaaacggtggtatgtgggccgatctatagcagaaactctgtaaaaaccctattgaatttcaatggggcagggcgcctcgtcttcttccgtggtacatgccttaaaacgcgaagaaaacgatgtgaatttgggcagagattacagcctgagccttccggatgaatgcctggcctgcatcttctgcactctgagctccggcgaccgacagcgatgctctctggtgtgcaagagatggtttcttgtcgagggttcgagtcgccagcggctatccttggatgcccggttggatatctcagcggcaatcccaggcctcttcagcaggttcgatcatgtgaccaagctcgctctcaggtgcgatcgcagaatggtaagtataaaagacgagggcttgattaaaattggaattcattgtaagagccttaaaaagttgaaattgaaggcctgtagggagttatctgatgtgggtatcgaggattttgctaagctgtgtactggtctgaaaaaattgtcgtgtgggtcttgtacttttggggcaaaggggatgaatgctgttcttaagtattgtgtagggttagaggagttgtctgttaagcggttgaggggtttagctgacgggagtgtcgatgttatcggccccgggtgtgcgatgttgaagagtatttgcctgaaggaactttttaacgggcagtattttggacccctgattgctggatcgaagaacctgcgtaccctcaagctgtttcgatgttcaggggattgggataagctgcttgaggtgatcactgatcatgtgagtggattggttgaggtgcatctcgagaggttgcaggtaagcgatcggggcctgatggccgtttcgaggtgcgcaggattggaggtcttgcatctggtgaagactccggagtgcacgaacgtcgggcttgcggcgatcgccaacaactgcaaaaatctacggaagttgcatatagatggttggaaaacgaatcgtataggcgatgaggggcttattgccgtggggaaaaagtgtcaaaatttgcaggagttggtgttgattggcttgaatctgactgcaacgagcttgagtcctctggcttccaattgccaggtcttggagaggttggctctctgtggcagtgagacgatcggggatacggagatctcttgtatcgctgcgaaatgtctttctttgaagaagctgtgcatcaagggttgtccagtttcggatgatgggatcgagtccttggtcagtgggtgtccaaagttggtgaaggtgaaggtgaagaaatgcagaggggttacttgggagggcgcggaacggttgagggcgaatagaggatctttggctgttaacttggatacgccgttgccgaatccagttgttggtccaccttcgggagctggtgccgctgaagctagtgccccttcaaccagcaaatcatcaatagccaaggcaaagttttctctctttgctggaagaaaccttgtggcctgtgcttttctgagattgtcaaatggatccgatggagatcataaacgagtgtctgcaaatgcatgagttgtttatcctattggaaaaacaaggccaagtcatgttattaagctctgctggagttgctttactgctcatggatcttttggcatagtgtttcctgatgcacggtgcagatatatgacttggcatctagatcaggtaatactaataatggagcaggaaaacattgtttgcaatgggctatttgcgttaaggttttcttgtgtgctaagcagttagtcaatctggctgttgaacatgttcttccaaagaacataaaccgcttgtatgcggtggacatccgatgtttggctttgtcttattggatgcgtcgtggagttagttcctttgtccattgaacaatcttccttaagggactgagttgacttgtttgcaatggaatgtgcacagccaggctttcagatgaaagctctgtcggctgtacaggtaggtagtttctggacaaagtagatctctgggttgtcagcttgagattctaagtgcaatgcaagagaatctgtgaagggatggaattaatttgtgcaatgttggcaaaataatcaatatgcatttgtcatacataatgtctaaaagagctctcgtttctgatagaaacagtatatttgaaatgggtatgtgtgcagcggccagccacactttcagatgaatctttctttgttataccagtaaacaggtattaagtctagtgaaaaaggagatcaccagatttttgtcaaatgtttaattaagtcgtttgctgtaagttcttcagtagatccaatataatctgcacaaggttggaattaaaaaaaaaa

SEQ ID NO: 109 - DNA, 1731 bp, Pinus radiata
gagttgtcccagttgggtacacagccaactccagctaacgcgcagtccctgctaggtgcctaccggatgctgctgactctgccgtcaatttcccttttattatataccactttattgcttcgcaagattcagccaagtggatctggctacagattttctcatctccaaggctgccagaactcaaatctgatcgcacacgactctctcctttggtcatttttggggcttttgggtgtttattgcggacacccaatgcccaaagatctggatccaatacccatttcctagatcagcgtaaacaacgcgtcggtttgatattcagcgtgtatccgtccattcaacgggagattgggtttctgcgatacattcgttgtgtatccatccaacagttattgggcgtctgcagtaggttgatattcattatctatcccttgaactagctattgggttcccgcaataagccgatattcatcgtgtatccattgaaaggctattatttttctgcaatagcttgatatccattgtgtattcatccagccagatattggatgtctatattaggccgatattcattatctacccattgaaccggctattgggtttctgctataaggtgaaattaactgtgcagctattcattcaggttttggattcttgagcacacccaagagttcgtttggtgttgtgtggagatggcttacaaagtcgatgatgattatgactatttgtttaaggtggtcctgattggggattctggtgtcggtaagtccaatttgctctccagatttactagaaatgaattcagcctggagtccaaatctacaattggtgtggagtttgcaacacggagtattaatgttgatgggaaaatgatcaaggcccagatatgggacactgctggtcaggaaaggtacagagccatcacaagtgcatattatcgcggtgctgttggtgcgttgttggtttacgacatcactcgacatgtcaccttcgaaaatgttgagaggtggctcaaggagcttcgtgatcataccgagcacaacattgtggtgatgcttgttggtaacaagtccgacttgcgccatttgagggctgtttccacagaagatgcccagacctttgcagaaagagaagggctctatttcatagagacatctgcactagagtccaccaatgtggaaaatgctttcaagcaggtgctgactcaaatatacaggatcgttagtaagaaggccctggatgtttcggaagataatgcagcagctcccgcacaaggtcaaacaataaacgtgaaagatgatgtcacggcaactaagaaagttggttgctgtagcacatcataagcagcaggtgaaatccctcaggattcggatttcagttcagatgcaggactattatgttcattggaaaaactttgaccgatttctggaatcacttatagttgaattcgagcaggttctcatttggtatgattttaagaggcttcaaagttggactcacttagtaactagttttagacggagagaagagtgttgtagccaatggtgggtaatctgaattgtatatcttattcttgctgtattctctgcaacttctagtgtcccagtactatctttgttctagtcagtggcttcagttttacatgccatcatttgtatccattatttgattttattctcacagtggaacagattttttttgatcttagttaatattaaaaaaaaaaaaaaa

SEQ ID NO: 110 - DNA, 1337 bp, Pinus radiata
ataatacccgatgccaattgtttatagcacagagtgctcttcttccactgctctctagctctcgtggcacacaaggaggagtttcagagaggccaggccagtctgcggatctgtgttcagacaagatgagtagcgacaaggagagggagaatcatgtttacatggccaaactcgctgagcaggccgagcgatacgatgaaatggttgaagccatgaagagggtcgcgaagctggacgtggagttaactgtagaagaaaggaatcttctctctgttgggtacaaaaatgtgattggggctcggcgagcttcctggagaataatgtcctctattgagcagaaggaggacgcgaagggcaatgatcataacgtgaaacgtatcaaagagtatagacagaaagttgaagcagagctttctaagatttgccatgatattatgaccataattgatgaacaccttattccttcctccaatattggcgaatctactgttttctactataaaatgaaaggagactactaccgttatctggctgaattcaaaacaggaaatgagagaaaagaagccgctgatcagtccttgaaagcttaccagacagcttcaagtactgcagagtcggatttagcgccaactcatccaatcagacttggattggccttgaacttttctgttttctattatgaaataatgaattcacctgaaagggcttgtcatctggccaagcaagcttttgatgaagctattgcagaacttgacaccttgagtgaagagtcatacaaagatagcactttaatcatgcagctcttgagggataatcttactttgtggacctctgatctccaggaagatggagttgaggatcagaccaagggggatgagcctgtagttgggatggatgaagagctttgagcaggtacatgtagaaacaaatgaagttgttagatatgggcttttatgtcggcctcaatgtactctagagtactcctttctgctctgcagctgcaatttacaaattcgctctatttatcttgttattgacacctggttttgtttataagttttagattggaacaaaagaccagtaggacattatggggtcttaacttggtgtgtataccatggctattaaatgcttcaatatgtaataggggcccagcactgcagtactgtgtagaatttagagtctttcgttgtgcattattatcgttttgaagattaatataggcttttgatggatgaagtggctttgttgccacaaaggagctgaattctttgagctttcctcgttttcttttttcaaaatttctggaagttatatcgaatctaacttaataaaaa

SEQ ID NO: 111 - DNA, 1235 bp, Pinus radiata
agagtgctcttcttccactgctctctagctctcgtggcacacaaggaggagtttcagagaggccaggccagtctgcggatctgtgttcagacaagatgagtagcgacaaggagagggagaatcatgtttacatggccaaactcgctgagcaggccgagcgatacgatgaaatggttgaagccatgaagagggtcgcgaagctggacgtggagttaactgtagaagaaaggaatcttctctctgttgggtacaaaaatgtgattggggctcggcgagcttcctggagaataatgtcctctattgagcagaaggaggacgcgaagggcaatgatcataacgtgaaacgtatcaaagagtatagacagaaagttgaagcagagctttctaagatttgccatgatattatgaccataattgatgaacaccttattccttcctccaatattggcgaatctactgttttctactataaaatgaaaggagactactaccgttatctggctgaattcaaaacaggaaatgagagaaaagaagccgctgatcagtccttgaaagcttaccagacagcttcaagtactgcagagtcggatttagcgccaactcatccaatcagacttggattggccttgaacttttctgttttctattatgaaataatgaattcacctgaaagggcttgtcatctggccaagcaagcttttgatgaagctattgcagaacttgacaccttgagtgaagagtcatacaaagatagcactttaatcatgcagctcttgagggataatcttactttgtggacctctgatctccaggaagatggagttgaggatcagaccaagggggatgagcctgtagttgggatggatgaagagctttgagcaggtacatgtagaaacaaatgaagttgttagatatgggcttttatgtcggcctcaatgtactctagagtactcctttctgctctgcagctgcaatttacaaattcgctctatttatcttgttattgacacctggttttgtttataagttttagattggaacaaaagaccagtaggacattatggggtcttaacttggtgtgtataccatggctattaaatgcttcaatatgtaataggggcccagcactgcagtactgtgtagaatttagagtctttcgttgtgcattattatcgttttgaagattaatataggcttttgatggatgaagtggctttgttgccacaaaaaaaaaa

SEQ ID NO: 112 - DNA, 1384 bp, Pinus radiata
cagagctcctataacccccaattgtgtctccatttttgcgtgcgaaccatggctcaagctcccaaaaatctgtgtatcattctgttcttcatcacaagttccttgtactgcccttcattgtcttgcgctgctgctttcacagaaaatccattaacagttcttggttctgccagtttagtgtgtttgtgcattgcagcggccgtttctttgaagatccagaggtgaagttgggtttttattatttgtgtacaaatggcggcagcggcgatggtggagtcatcgcgggaggagaatgtctacatggcgaagctggccgagcaggcggagcgctacgaagagatggtggagttcatggagaaagtgacaaaaggcgtggaggtggaggagctcacagtggaggagcggaacctgctatctgtagcctacaaaaacgtgatcggtgcccgcagggcctcctggaggattatctcctccatcgagcagaaggaggagagcaggggcaatgatgagcacgtggtcaccatcagggagtacagagccaaggtggaagcagagctttccaagatctgtgagggcattctccgcctcctcgactcccacctcatcccttcttccaccgctgcggagtccaaggttttctatctcaagatgaagggcgattaccatcgataccttgccgagtttaagacaggcgccgagaggaaggaggccgctgagaacactctgcttgcttacaagtctgcgcaggatattgctgcggcagagctggctccaacgcatcctattaggctagggctggctcttaacttctctgtattttactatgagattttgaattcgccagacagagcctgtaatctcgcaaaacaggcatttgatgaggcaattgcggagttagataccttaggtgaagattcttacaaggacagcactctcatcatgcagctccttcgtgacaatttgacattgtggacctcagacatgcaggaggatgctggggaagagatcaaagagacttctaagcgtgaggacggggaggagcaatagtgaaatgtgataatcttatagtgtattaggattaggattagattaccaggctttcctgcattgtttggtaaaggaggcctatgtgcacgattgtgtttattagatctcatgctctgcagcatttagttgctgtgggtagcatattcttagtcatattttgttggctgcgtttatgttggcattttatatcatctatttgcgaatggttggagacagtggcttggtactgtaatatcagattggtggagtctatcaacaaatctgtaggcccattctgcttttgtgttcaataatattttttattgtcttgatttaaaaaaaaaaaaaaaaaaaaaaa

SEQ ID NO: 113 - DNA, 2556 bp, Pinus radiata
gagaactaaaaccaataaaacttgaagctttaaaagggaacaggtcgaggacgaagccgagtcttgtccgtgaacaatgaataagaaaccagatgcttgtaggttatacgccagtccttagaattattatccctacgatcgtgggaaagcttttcgttctagcctggaggaggagaagtcaagttatcgttgctatgtcccacgagattgaacacatcgccttgtcgctagagattttggcggtgtagagccctttttccagtccactctggtcttatcaatttccatttctctctttatcgatattaaacggaaggccacggtatcctctcttattgaatttctccgaaaatccggataagcaaaatccggataaagagcgattcaatcatcatccaattgcggctgataacccagcaggactaggctggattcaaacctcaacagaaccagactctaaaacctggaggcgaactccactttgaaacagagtttgaacccatggagcgctagtggactgtttatctatatgtaaatgtaattatcaggattggaacctcagttggaccagaatctgaaaccttgtgatgaactttgcctcgaaacagtcgatttgaatccgttgatctaaccttaataggctatttgtctatatacaattatcagaagtcctgattaaagagaaatggatggaatgtctactcgaggtggcagcaattttgatatgtatttgcctaattataagctcggaaagacgctagggattggctcgtttggcaaagtgaagattgcagaacatgcattaacaggacacaaagtggcaataaagatacttaatcgcaggaagattagaaacatggatatggaggaaaaagtgaggcgggaaatcaaaatattaagattatttatgcaccctcatatcatacgtctctatgaggttatagaaactccatcagatatatatgttgtgatggaatatgtaaagtctggggacctctttgattatattgttgagaaaggtcgattgcaagaggacgaggcccgatgctttttccagcagattatatcaggcgtggagtattgccacagaaatatgattgttcatcgtgatcttaagcccgaaaacttattgctagattccaaatgcaatgttaagattgcagactttgggcttagtaatgttatgcgcgatggacattttcttaaaacaagctgcggcagtccaaattatgctgcccccgaggtaatatcaggtaaattatatgcagggccagaggtagatgtttggagttgcggagttatattatatgcacttctttgtggaagtttgccatttgatgatgaaaacattccaaatctcttcaagaaaataaagggtggaatatacacacttccgagtcatttgtcatctggagcaagggatttgatcccaaggatgcttgttgtcgatcccatgaaaaggatgaccattccagagattcgtcagcatccctggtttctagagaaacttccacgctatttggcagttcccccacctgatacaattcaacaagcaaaaaagattgatgaagaaattcttcaggaggtgattaaaaggaattttgacaggaaccagttggtagaatcccttcgaagcagaatacagaatgaggctacagttgcatattatttgatgctggataatcggagccgtatctccaatggttatcttggctctgagtttcaagaagcaaaggattgcatacatcactttgtaccaactgatcgtgcaacaccaactggtgatcacagattaactggttttattaatcagggaaatgcctcaagatcccaatttcctattgagaggaaatgggctctaggacttcagtctcaggctcatcctcgtgagattatgtcagaggttctaaaggcacttcaagagctggatgtcgcatggaaaaagataggacactacaatatgaaatgtagatggtttcctgctgtattaaggaaagttgattcttcaatgaataaatctttgcatggaaaccatattattcaagacgactctacagctggcatcaactgtagatctccgccaaatgtggtcaagttcgaagtgcagctttacaaagccagagaggagaaatatcttcttgatcttcaaagggtacaagggccacatttcctctttcttgacctctgtgcagattttcttgcacaacttagagttctatgacatgaaagacttttaggaatatttaaggctcaagagattctaaggaatataatggtagtttaccagattatatggttactatcaactgttcgattgttctagtgtgcagtaatgaaatattttgtatagtagtatgctcatcatattctgttctgaggagctgaaaatgagagaagataaatgaatcaccagtaatccccttcttgctgttgttgcaacaaggtttggattttcattatcccccagacagctaaaagttatttttttcttcgcaatttatgcgatttaaagaaagctttgttttttactccaaaaaaaaaaaaaaaaaaaaaaaa

SEQ ID NO: 114 - DNA, 2389 bp, Pinus radiata
ggttgacaagtcggtgcaccttacccttaacgtgctttgccgaataccatcgtagtagtagaactagccggaggaagggtcggaaacttatggaagtttaagttgtatttagagaaaatttggcaaggatttttggatttataatggttaaattttaaactttttaatttttgatgatgttgaatccattttccacatgatacaaaaactttctctaccaaaattttggaacttttaccggattcccgccacttttgacggtctaggcaattcgtctgccttgttaaacgacttatttaccatctcccaggacgagtgagaaggttgtatatctcccatgagaagaaggttgttggagttccagtgcatgcacctaacgttaacctgcgattccctattgtttcctatttcccaggaggagtcagaaggttgtatatctcccagaacttagaaggagaaggttgttcgagctccagtgcaacaacgatgacaatagccaggagatgttcttcacttatagtgcgaggagtgcggtctgctggttcccgttcatctgctgttggatcgccagctctatcaaaacaagcatcaacaaagaattccagaattcaaagatttggaacagctgcaagtgctttagaggaacctatagcaccacctgtccaagtgaagtacacgcatcttcttattgatggacaattcgttaatgcagcttctgggaaaacatttccaacctttgatcccagaacaggggatttgattgctgatgtggctgaaggcgatgcagaagatgtggacagagctgtaaaggctgcacgaaaagcctttgatgaaggcccatggccaaaaatgactgcttatgaaagatcgtgtattatgtaccggtttgctgacttgcttgaaaagcataatgatgagattgcagctctggaaacatgggacaatgggaagccttatgagcaatcatccttggtcgaagtgccaatggcaatacgggtatttcgttactatgcaggttgggcagataaaatacatggccttacaattccagctgatggaccttatcatgttcaaactttacatgaacctattggagttgcaggtcaaatcattccttggaattttccattgcttttgttttcttggaaagtggctccagcactagcttgtgggaacactattgtattaaagagtgctgagcagacatcattaacagctatttatgcagcaaagcttttccatgaggctggactgccttcaggagtcctgaatatcattccaggatatggtcgaactgcaggagttgcaattgcaaaacacatggatattgataagcttgccttcacaggatcaactgaaactggtaaagcagtactagagttagcttctaagagcaaccttaagcgagtgacattggaacttggagggaagtctccatttatcgtatgtgaagatgctgatgttgaccaggctgttgagcttgcacactctgctctatttttcaaccagggtcaatgctgctgtgctgcatcacgaacctatgtacatgagagcatctatgatgaatttgtagaaaagacaaaagcacggtgtttaagtcgtgttgttggtgatccctttaaaaaaggcgttgaacaaggtcctcagattgaccagatgcagtttaacaaaattatgagttatattaaggctgggaaagagagtggtgcaaaacttgtaacagggggagagcaaattggtaccaagggcttctacattatgcccacagttttctcagaagttcaggatgacatgcccattgccactgatgaaatatttggccctatacaatcaattttgaaattcaaagatataaacgaagtaataaagcgggctaatggtactgattatggcttggcagcgggagtctttacaaagagtatggataccgcaaacactctcactcgtgcgttacgtgcaggatcaatctggattaattgctttcacatttttgatgccggtgtaccttttggtggctataaaatgagtggcaccggaagacaaaagggaatatatggtctccaaagttacttacaggttaaagccgttgtgactcctttgaagaatccagcatggttgtaggctgttacgttccttctaatatatttgatgaatgcagaacatatttaatcccttgtgctattgtcaagtcagtctactttgaaataaactctctattactagaaatgtgttaccttcagaggggtgggatggttcgtttagctgggcatcctatagtaacgtctctgtaaaactgtgtagattcagacgttagaactctggttagctgtgcatcctatagtaacgtctctgtaatacggtgtagattcagacgttggaaatcaattat

SEQ ID NO: 115 - DNA, 1970 bp, Pinus radiata
gttggagttgcacacaaggttggaggaagaaagttgttggagctctcaggttgaacgaaaatggcagcaatgcgagcaggcaggggattttcttcacttctaactcgagcagtccggtcggctggtacacggtcacccgccgttggattggcagctttatcacaagaagcatccataaagaatactgggattcgaagtttaggaacagcggcaagtgctttggaagaacctatagcaccacctgtccaagtacagtatacacagcttcttatcgatggacaatttgttaatgcggcttctggaagaacatttccaacattggatcccagaacaggggatttgattgtcgatgtggctgaaggtgatgcagaagacgtggacagggctgtaaaggctgcacgaaaagcctttgacgagggcccatggccgaaaatgactgcttatgagagatcatgtattatgctccggttcgctgacttgcttgaaaagcataatgacgagattgcagccttggaaacatgggacaatgggaagccctatgagcaagcagccttggttgaagtgccaatggtagtgcggctatttcgttactatgcagggtgggcagataaaatacatggccttacagttccagctgatggaccttatcattgtcaaacattacatgagcctattggagttgcaggtcaaatcatcccttggaattttccactacttatgtttgcttggaaagttggtcctgcactagcttgtgggaacagtattgtattaaagagtgctgagcagacaccattaacagctctttatgcagcaaaacttttccatgaggctggactgcctccaggagttctgaatgtcatttcaggatatggtccaactgcgggagctgcaattgcaagacacatggatattgataaggttgcttttacaggttcaacttctactggtcaagcagtgctagagttagcttccaagagcaaccttaagccagtgacattggaacttggaggaaagtccccttttattgtatgcaaagatgctgatgtcgatcaagccgtggaactcgctcactttgcattatttttcaatcagggtcaatgctgctgtgctggatcacgaacctttgtacatgagagtatccatgatgagtttgtagaaaaagcaaaagcgcggtgtttaagtcgggttgtcggtgatccttttagaaaaggtgttgagcagggtcctcagattgatcgggaacagtttaacaaggttatgggttatatcaagtctgggagggagagtggtgcaaaacttgtaacagggggagaccaaattggtaccaagggcttctatattatgcctaccatcttctcagaagttaaggatgacatgggcatagctactgacgaaatatttggtccagtacagtcaattataaaattcaaaactttagacgaagtaataaagcgggcgaatgctactcgttatggcttggcagcaggagtgtttacaaagaatatagagaccgcgaactctcttactcgggcattacgtgtcggaacagtttgggttaattgctttgacatttttgatgctggtataccttttggtggctataaaatgagtggcactggaagagagaagggtatctacagtctcaataactacttacaggttaaagctgttgtctctcctttgaagaatccagcctggttgtaggctgttagttcctacaaatggttctattgtgtgggggaacatattcagttcctgatggtcttgtcaagtcagtctaatttgaatttagctttctctgtcaataattaatgtatatgaccttcagagaggtgtgatgctcttgttttcctgtgaaccttcacagttgtgtctctgtaagattctgtggtttcagaatttggaactcaattatcatggccatatcaaatgcgaaatgaagggtgtcattgtttctgccaaaaaaaaaa

SEQ ID NO: 116 - DNA, 3197 bp, Pinus radiata
gctctttttagagccttgggcagcttttggggtgtttttttttttctgtgagtggaattgaagtagaagttgaagctgaagctcccctggatgctccagaggcttcacaaatatctcagtttctgaggcttcacaaatatctcagtttctggaataggtggaagagattgaggttggttgtttgtatgtatgtacagtaggcttttgggtttttttttgggtttctggagtggctatatggatcatgaaggcaggggaggaagtggtttattggcatgttttgggatcagccgccatgaagctggagtgcattaatggcggactcgacaaattactgcaccttgggatggagaaaaagggatttgggatattttggacataagggattttttcaatagaaatcccgtgaaatcccttgaaatcccttaaaactccttgctgattatttttagcaaattctccgagatctcggatctcgactttacaattatgaagcgacaacactttcaattgcagcagcagcagcagccgcagccgaacggtcatggccgctgctgcagcactgttccggtccatcccaacccggtgtccatgccagggtccgggccaccaccacaagcaccaagaacaacagcaacagcgcctgcagcgggagcggcagcagcagggggaggtggaagttcagggtcttgcaagggcaaggaagtggtattgaaggatacttgtaagcagggtgtaggtgtggatatggaactggcttccatgggttacagtgtgaaatcctctgaactggaacaagtggcacacaggcttgagcagctggagatgatgatgtgcaacgggcaagaggatggcatcatttcccacttgtcgtcagaggctgtgcactataatccctcggacctcggtggatggattgaaagtatgctcagcgagcttcatgtccctattcttcctccaacagatcagccgtttcagttccctcaggcagcagcggatcaatcctctacggttcgggaagcgagcaattcggtgccggaatcatccacttcgacttcgaagggcaccagatctgtgcagaatgttgaacaggaccaacagtacagattaaatgggtccggggccgggttgtttgagccgcctgaggtcctggatcgatcagaattccagcttcatggctatccgggccaagggggagtacgagataatgggattgatcgcatgttcggtaactatggcggccttttttctcaagtattagacgtctcggacctgctagtcgatgaccctgatgttctacaggaaccaccaccacaggaggcttcgccctcaactctgctgctgcagagctccagcaactcttcgcttgaagtccaatccgggcaagaccgtctggaagaggatgttacgggaagagagcaaaagcgttaccgtgtctgcgacccggagctttcggagcgaaccgtggtagtaatgggggcagacccgcacgaatccggagtccgtctcgtgcacacgctgatggcctgcgcagaagcggtgcagcgcggtaatttggccatcgcgcgggaaatggtgaaagaagtgagaattctggcttcagcacagggcggggcaatgagcaaggtcgccacatattttgccgaggctcttgcccggcgaatctatgggtttctccctcaggacaccttgcggttcaaccagaacgaccccttgtccgattttctgcaatttcatttctaccaaacctgcccctatctcaaattcgcgcacttcatagccaaccaggccattctggatgccttctccgggcaccaacaggttcatgtcatagatttcaatctgaaacaggggatccagtggccggccttgatacaggcactggctcttcgccccggcgggccaccggctttcaggctaaccggaatcggcccaccccaacccgacggaaccgatgcattgcaggaggtcggcacgaggctccaccaatttgcagagtccgtcaatgtaaaattctccttccgtggctatgttgccacaagcctcgccgacatcaagccatggatgctcgacgcccggcccgagctcgaggctgttgcagtgaattctatccttgagctccatcgtctcctggaggaccccatccccggacgacccagtgccatcgatcgagtactcgcttccatctggagcctgaagcccaagatcttgacagtggttgaacaggaggccgaccacaaccgccctgttttcttggatcgattcacagaggcactgcattattattccacagtttttgattccctggaggcgcgcgggttgcaggcccagagcgaagagcaggtgatgtcggaagtctatctgggtcgagaaatttgcaacattgtagcctgtgagcgatcggaacgggtggaaaggcacgaacctctcttgaattggagcgttcgcttgagaaacgctggcttctggcctattcctttgggatccaatgctttcaagcaggccagcatgttgctcagtctcttctcaggtggagaaggatatagggttgaggagaataatgggtgtctaacacttggttggcacagtagacctctaattgctgcttctgcctggcaacgctgttaatcatctatctcacaccatcaagaaggtgataggtggatcaaatacccagcaattattattgcagcagcatcatcgtttcagggaacccacaacagcccaattcaattccggatcaggtcagctaaagcaaaattaacgagtccgtagattacctaccagcgccgagaatctattcatgtgtatcatactgaagttcttgagttattataagcaaaattagattacacttattattagctcgactcagtgccctgtacgacttcataaatcactgagcgatataatttgtaatctctcaaacactttgaacttcaaatgtcagaagcattgaatctcacacggcctatatcataagtaagttattattgctcacagagatctctgccaatgttgcatcgtcctgatgtaatcaagagaattgaatgccaagcaacttcccatcatcaattcttttaattctcagtgattcagtgcatgatattagatttttcatttacttctcttgaatatgaaattcctaattaatgtgggaattaccttcaccgattttgctgaaaaaaaaaaaaaaa

SEQ ID NO: 117 - DNA, 2048 bp, Pinus radiata
cccacctcgtacacacataaaaataaagggcagtgagttgaacctgccacagcgtataagcaatagcactgaaaatgaataaaaattaaggcacagccttctgttagcgccctacccaagtgaccatccttgcccgagtctagccgcgtggaaatttttttgaagcctctatccaccaatttgtgcaccctgttacaactcgccagtataggtctaaatctgcatttacacaacccactgggcttcttgcatcaattcagacaggtttttgggtggcaaaatattgggaaatggcttattcaggcagggctcggcgtcccatctccttccttctgaagcagttgaagacatcccactcatattcttcgtggactcgctgtaatggatttaatgggcagtccatgtttcagtcaaatgccatcagcaggtgcaaggcaccatcattcaggcctactgctgagttgggatgggttttgggttttagccattcgtgcagagggtacagcgctgaagtgggttccacagagcaagtgggtctaattaaacaactgagagaaaggacaagtgcacctatgaaggatgtcaaagctgctcttgtcgattgcaactgggatctcgaggctgcatatacagaattgaggaagaagggtattgcaggtgcatcaaaaaaaggggcccgtattgctgctgaagggatactggcattggctcaagatgagaaagtggctgctgttattgaactaaactgcgagacagattttgtcgccaggaatgaaatattccaatatctggcacattctgtggcaaagtcagcattgaccatggaggccttacctgaacttctatcagaatctgcgacattagatctaaagctcctaggggaaatgaacattatcttagatcatcctaaactaactagggagataactgttcaagatgcaattatggaagtggctgctatcatgggagagaatgtgaagcttcgaagaggttttgctttgtcctctgcaaatggcgttgtttcctcgtatcttcatacttctccgcaaccagggcttggtcgcatagctggcctgttgacattagaatctgaaaatgggggtgcaccaacagaagtgcttcaaagggtgggctcaaatcttgcaatgcatgttgttgcagctaggcctttgtttctctcaaaggatcatgttgcaactaaaacattagaggctgagcgtgatatcctcaaaactcaggctgctgcgtctggaaaacctcaagctgctatagagaaaatggtagaaggacagttaaggaagtttgtggaggaaattgcacttttggaacagaagtttgttatgaacgataaagtaaatgtcaagtctgtacttgaggacctatcaaaggaggttggacaacagatcagggtgggaagtttccttcgagtggaggttggtgaaggcatccacaggcaagaaacttcctttgctagtgaggtagcagctcaagtcggataactgattacctttcagatatataatatagtctgacatcaatggtaaaactgaaaccttcaagagttcaggaatgccaattggcatttgcttattgatgctcgccagtggcatttcatagtccatttacaatgaaaatggccgatttttggactttagatcttagtggttgttcagtgactttgaaagagtgatagcatttacattgttttgaatgtagtagtatatactatattcaaattgtttctcatggagcacagaagagtagattgcctcaggttaagttaagacatgaacctttcgagtaaataaaccaagcagagaagctggctgcagaatgtaagaataaaatatattgcttttgttcaagttttgttccgatgctttatgctgatattgctcagatttgtatggtggaagtgagcgcttcattttgggcggttttagtcaaaactttattctacattaagtagattcaagactaagaataagaactaggcgagcgccataccttgctgtgaaggataatatgttatataagggagagtctaa

SEQ ID NO: 118 - DNA, 1705 bp, Pinus radiata
gggaagatctaccccacctgggatgaaggcgccgaacctttcaaggccaccaaggacattcgtcgaagccattcaaattcccttttgcgatcagaactgtgctggattcctccccgttcctgctgggtgctgcgaagtagcagaagaagaagcagcttctggaggaaagagaagcagagggtttgcggtttgtggatgcagaagaagaaggcaccgccatggaagcgagcgctgcggcagctgatggtcacatacagggaattctgactcatggtggtcggtatgtacagtataatatcttcgggaacctcttcgaggtttcctccaagtacgttcctccgatacgacttatcggccaaggcgcatatggcattgtttgtgcagcagtgaactcagagacaaatgagcaagttgctatcaagaaaattggcaattcttttgcgaataggattgatgcaaagaggactcttcgagagattaagcttctatgccacatggaccatgaaaatatcattgcaattaaagatgtcattcgtcctcctcagagagagaattttaaagatgtttatattgtatatgagctcatggatacggatctctgccagataatacactccaagcaaccattatctgtggatcattgtcagtattttatatatcaattattgagagggctcaagtatatacactctgcaaatattctgcatagagatctgaagcccggtaatttgtttctaaacgaggattgtgacctaaaaataggtgattttgggcttgcacggactacttcagacacagactctatgacagagtatgttgtcactcgctggtatcgagcaccagaactactattgaattgttcagagtacacagcagccattgatatctggtcggtgggttgcattttcatggagatactaaagcgggagcccttgtttcctggtagtaattatgtcgagcaattaaagctcatcactgagtttattggttcaccagatgattctgatcttggctttttgcggagtgataatactagaagatacatcaggcaactcccacaggtccctaagcaaccttttgctcagaaatttcctaacatggacgaagatgccctagatttacttgaaaaaatgcttgtatttgatccaagcaagcgtatcacagttgaagaggctttgagtcaccgttacttagcaagtctgcatggcatcaatgaagaacccagatgccctgccccattcaattttgattttgaacagggcacgttcaccgaggaacacataaaagagctgatttggagggaatctcttaacttcaacccagacatgatggaatagctggagtagatgggcttggtatttatctatttgtaatccttctttggtggttatgttactatgcttatactgtgcaatccatctgttggtttattatcggccttatgaaagttcgcagatcatagtgcagacatgggtgggcttgttttattcttattcttgttttgctcttattctctgaaggtttggtaaaggtaaataatcggatggatatgtgtactttgcatatccagacagagattggagttgtgtattctaaatcgaggccagctattgggccttatgcgattattattattaaacattaaaatgtaataagtaaatttaataatctaaagtacatgtcgagggaatttgtaaaaaaaaaa

SEQ ID NO: 119 - DNA, 1533 bp, Pinus radiata
ctacaacgaaaactcctatatatatagggtgcctcggtcttcgactcctcatcgagtccgctgtctgttggaagtatacacagcttgccagtacgctgtttttctgcttttctgtttgtgatttatcaaagatggcagtccccgtgattgacatgaagaagatgttgaatggagaagagagggaagtgacgatggccaagatacaaaatgcctgccaagaatggggcttctttcagcttctgaaccacggaatacctcacgctcttctcgaccgagtgaaggagctgttcaaggaacattacaaaaattccatggacgcagaatttcagaagtctgagattgtagggatgcttgaaagtgctgtctcccaaggcaagaatttcggtactacgaagatagatgacgactgggaaacgggcttcttcctccaggatgaaacttatgacacagtgtcacctcctttgcctaccaatctcaaagagacgatgaaagaatttagtgaggaagtaaagatactcgcggaaaggatattagatataatctgcgaaaatctgggactggagaaagggtatctgaaagaagccatagcagggggcaatggcgacggcaaagcccctttctttggcataaaaatggctcactacccgccatgcccaaggccagaactcgtcgatggcctgcgcccccacttggacgctggcggagtcattctgctactgcaagatgatgaagtgggtggccttcaagttctgaaggacggcacttggttcgacgtcgaacccattcgacacgcaatcgttatcgacattggcgatcagctggaggtgatgaccaatgggaaatgcaagagcatgtggcatcgcgtgctttctaaaaaggacgcgaatcgaatgtcggtcgcagcgttttataacccatcgaccaatgcggaggtgtttccagctccacagctgatcatgaaggcgacagagcagaatggcaatgaaaatgacaataataatatgaatgcccaaagtggctatagttatccgaagttcgtctcaaaagattatatgaaagtctatggtgagcagaagtttctcgagagagagccgcgattcgaggctatgagagcactctgttccctgaagtaatcttcttgaggagatactagctcccagcaatgcttcactttcaactggttctggttataaacttaaagaattagaattagattaatctatataggaaatagagctcttccctgtgtattttcttatcgagttccatcgcaatatttaggatctttgtatggaatagaattagaataggatacagcaggttggatattatccaagtggttattactcttttgtaatctccactcccagtaagcgcgttaaactttattcgtacagactatattcatatcggaggactttgatgacatatcctcttttaaattgtgtaaacagttatgcagacttaatttgaatactttattgagatgcaactgtgcatccatttctaagcattaaaaaaaaaaaaaaaaaa

SEQ ID NO: 120 - DNA, 1458 bp, Pinus radiata
ctcgtgccgtgacgatggccaagatacaaaatgcctgccaagaatggggcttccctctcttctccattcaacatcttcttcatgtcaatcacggggactgccatgaagaagatgttgaatggagaagagagggaagtgacgatggccaagatacaaaatgcctgccaagaatggggcttctttcagcttctgaaccacggcatacctcacgctcttctcgaccgagtgaaggagctgttcaaggaacattacaaaaattccatggacgcagaatttcagaagtctgagattgtagggatgcttgaaagtgctacgaaaatagatgacgactgggaaacgggcttcttcctccaggatgaaacttatgacacagtgtcacctcctttgcctaccaatctcaaagagacgatgaaagaatttagtgaggaagtaaagatactcgcggaaagaatattagatataatctgcgaaaatctgggactggagaaagggtatctgaaagaagccatagcagggggcaatggcgacggcaaagcccctttctttggcataaaaatggctcactacccgccatgcccaaggccagaactcgtcgatgggctgcgcccccacttggacgctggcggagtcattctgctactgcaagatgatgaagtgggtggccttcaagttctcaaggacggcacttggttcgacgtcgaacccattcgacacgcaatcgttatcgacattggcgatcagctggaggtgatgaccaatgggaaatgcaagagcatgtggcatcgcgtgctttctaaaacggacgcgaatcgaatgtcggtcgcagcgttttataacccgtcgaccaatgcggaggtgtttccagctccacagctgatcctgaaggcgacagagcagaatggcaatggaaatgacaataataacatgaatgctcaaagtggctatagttatccgaagttcgtctcaaaagattatatgaaagtctatggtgagcagaagtttctcgagagagagccgcgattcgaggctatgagagcactctgttccctgaagtaatcttctcgaggacatactagctcccagcaatgcttcactttcaactggttctggttataaacttatgttcaataaagaattagaattagattaatctatataggaaatagagctcttccctgtgtattttcttaccgagttccatcgcaatatttaggatctttgtatggaatagaattagaataggatacagcccgttggatattatccaagtggttattactcttttgtaatctccacttcccagtaagcgcgttaaactttattcgtacagactatattcatatcggaggactttgatgacatatcctcttttaaattgtgtaaacagttatgcagacttaatttgaatactttattgagatgcaactgtgcatccatttttaagcattaaaaaaaaaa

SEQ ID NO: 121 - DNA, 1602 bp, Pinus radiata
gtaattctctttcgtttttcccgtgacatacggcaggatttactctgatttttcacaggaattcccaatctcgcggaattttattaagcagccgcagatggtttctgtcgctgtaccgtcatggccatttcagagtagcaccgactgttcagctatcgacaagtacacgctaagctccccagcataatttggaggattttgtgaagaaaaggcgaagatttggcggaaatcactccaaatctggccggactgagttcacaacgtggagttgcgggccattgtcagaatgatcgggtttatatttgcagaactgttcttacttggcaatttcggaggtcgtctgcttatttccgtcagagatatagagagttttgacgagacttggcattcggttgtcgatttcagaggttttgatttgcttcttggttagaggttttgatatttgagctgagttgggtttttgagagtaggatggcgagtccgtacggagattacgatcagagaattgattacatgtttaaggtggtagtgataggagactccgcggttggaaaatcacaaatactgtctcggtttgcaaagaatgagttcagcttggactcgaaatcaaccattggagtcgaattccagacgaggacagtcgctattgataacaagactatcaagacacaaatatgggacacggctggtcaagagagatacagggcagttacaagtgcttactacaggggtgctcttggggcaatgttggtgtacgacataaccaagcgccaaagcttcgaccatgtggccaggtggcttgaggagttgagaggccatgccgacaacaatattgttatcatgctgattggcaacaaatgtgaccttcgtgatatgcgtgctgtgcctgaagaagatgcaaaagaatttgcacagagggaaggtctttacttctttgaaacatcggcgctggaggcaattaatgtggagatggccttcataacagctctgactgaaatttaccggatagtaagcagaaaggccctcacagcaaatgaggatgaaaggaatgggaatgcggctgcattaactggcactaaaatctctctatcaagcccagagcagtctgtgatggctgtgaagaaaaagagctgttgttgatcatctttattgtttatcgtttcactctgtttggcaatgacatgatcccttttgtaaaatcgatttgcatttttcagtcatcctaaactgcaggtctacttccgagagttgttgaaacccgtttagattctaaaatttcgttgccgaagcacatctttgcatccatgtatttacagtataagagattttctctgcattctgatttgatatcttgaatattttacagcgtttcactggtatcaaaatggaagcccatatctgtaattagtttagcattttctcagtcgctggctgaaggggtcacatacattgctcatttccactggctaccaatggaattgcaagatttccccttgaacaaaatgtcacacgttctccgttgtgagatccatgtgaggaagttttgccatcacaaatatttttatatgtatttcattattttgttattaaaaaaaaaaaaaa

SEQ ID NO: 122 - DNA, 1111 bp, Pinus radiata
tccagcttcagtttgggagtactaccagggattcacaggcgagcaaaatggatcgactgatcagcggccaaaccacgtgcaattcagtcgagaagcagagcaatggagattcgaacctcgactattcagtttccgatgcggtcagagacaagctgcggcttatgagagacagaattgagaaggaagatcccgcctccaaggttacagatgatggtactcttctacgtttcttgtatgctcgggaatcaaatgtggaaaaggcttgtgagatgtttgcaaagtatagaaaatggagacagacttatgtaccccttggatacatcccagaaacaatggtcggcaatgagctcaagcacaaatttgtctacatgcaaggatatgacaaagtgggaaggccgataatggttcttcgtctggcaaggcacattgcttcccagtcgaatatggaggattttaaacgttttgttgtctatgcctttgataaaatgtctgctagtgctacaaaaggacagacaaagttttccattatagcagattttgctgattgggcatacaagaatgtgaaccttcgtggcactattgcagctgttcaaaccttgcaggacttctatccagagcgcttagggaaggtgtaccttattaatcgaccatacatattttgggcagcatggaagatagtttctccttttattgacaaagtaacaaggcaaaagattgttttcaccgacgataaatatgtcaaagaaacattactgaaggatattgatgaaaatcaactacctgaaatctatggagggaaattacctttagttgcaattgatgattgtgttgtaccaaattggcccccaataacctcattttaggaatctagaagaactttaatagcgatgatcatattgaagtatattagttgttctttaatagcgatgagcatattgaggtatattggttgttctttagtgtttataccgaaatcataaattgttcctcaaatttatttcaacttcttacaagaacaaaatttttaaaacaattaaattgttcaatgttaactatttagaataactttttaaaaaatgttcaatgttaacattttagaataaaaaaaaaa

SEQ ID NO: 123 - DNA, 1476 bp, Pinus radiata
cgcctcggagggtttctttgcgcgaagatcacaggtcagaatagccatttggtgaagggaatctgtggtttcttatttcagagcactggtatcagtgttagtcgttcggttcacgtcattttgagcccaaatttgaggtctttctgtgcggattcggtaaaaaatgacggagaaggagagagaaaatcatgtttacatggccaagcttgccgagcaagccgagcgatacgatgagatggtggattcaatgaagaaagttgctaagttggatgtggagcttactgtggaagagagaaacttgctctcagttggctacaagaatgtcattggtgcaagaagagcttcatggcggataatgtcttccattgagcagaaagaagaggcaaagggtaacgagctcaatgtcaaacggatcaaggagtaccgtcacaaagttgaagatgaactcagtaggatttgcaacgacattcttacaataattgatgaacatctcattccctcttctagcactggcgagtctacagttttctactacaagatgaagggggattattatcggtatcttgcagaatttaagacaggaaatgaaaggaaagaagctgcagaccaatctctcaaagcttatcaggctgcttcaaacacagcgactacagatttggcacctacccacccaatcaggcttgggctggcattgaacttctcagttttctactatgaaattttgaactcgcctgagagggcctgccacttggccaaacaagcttttgatgaagcaattgcggagcttgacactctcagtgaagagtcatacaaggacagcacattaatcatgcaactactgagagacaatcttactctctggacttcagatttacaagaagaaggaggggaagatcaacccaaaggtgaagaggataagatagaagaaattgagcactagtttcagaagggcagtgtaatgactactttcagcataacaactgccatggcagttgtatgctggaaggtagtttatatttgctatgtttcttcattcctccgtgctggtcgaggcgctctgcatagactaaattgtattcatgattcctgttgccagtttttattttttattttggtgaagtgggtttaagttaggttggaactttgaagtacattagtgttctgcactttatatcctaagttggaggtcttttgaatttttagttccacatgcatggaatgttgatgcacgattttctgtttcgtcactattaagttgataggaagttttaatttgtaagccatgagttggctgattgggctcaaattttggacttgcctgctttatttgagcagaagttgtggacgtgtctctaaatgtaagaggtgaatgtatttgacactggaccgtgtggatgatgcagattactaaaaaccttgcgttatgaaagatgctacctataaaatgtggtttggctgttggttttaaaaaaaaaa

SEQ ID NO: 124 - DNA, 1543 bp, Pinus radiata
caagcgaattttttgtttattttaagtgaagtcagatagtggtttgagcttcggtgcgggatacacagatccacgtctgcattgaatgcaaacaaaaatcaagggtggtaacctcgtgtgatccgcggggagaaccgtcaaaccaccctcccaaattttggtcccagttgtcgctttgatttgattcgatccagccgttttcgctcttcaattcaaccttcttcgcggtcggaaaggttcaatttggagcaacatcggaccaaattgagaagcgttccaagttccagtataaatgcgcaaggggacagccaactgaattcaagctcacgagaccgtgtagatttgccctgttgaagtcttgggggttcttttacaagcttcttcagcaaaaattataattgactgcagagatggtcaaactgacgatgattgctcgtgttactgatggtcttcctttagcggaaggcttggatgatgggcgggaacaaagagacctggaattttataaacagcaggccaaggcattgttcaaaaaattgtcacacggtcaacatgaaccttcaaggatgtccattgaaactggcccatttatatttcactatatcattgaagctcgtgtttgttacttaactatgtgtgatcgctcttatccaaagaagcttgcatttcagtaccttgaggagctaaaaaatgagtttgaaaagttgtatcagtctcaagtagaaactgttgcaagaccatatgcttttattaaatttgatacatttattcagaagacaaggaaactgtacttggacacacgaacacagcggaaccttgctaaactaaatgatgatctatatgaagttcagcagataatgacacgcaatgttcaagaagtgttgggagttggggagaagcttgatcaagtcagtcagatgtctagtcgtctgtcatcagaatctcggaaatatgctgataaagcaaaagatttaagcagacaggcatttatcaagaagtgggcacctgtggccattgttctgggagttgtttttgtgctcctgtggatgcgatggtatatttggcagtgattttctttcagtcattattacattacctgggtaagagtggagtttagctgctcagaggcagatagtaacaagcaggtaatatttttgagggagggcatttggggtagcattttgttttggcttggttgctttttattgaatgcaaattcgaaatgaggaaagagagatcttactgagggcagtgaccagttgtatgccgagcttgattggtacaggtgaacgtgaaacaagtttcactatttgatggatgagatgagtaagattttattttagttgttagaattacaatcttagaggaagataataatattgttctggtcagatagcttattcatcagggagatgaaattttaaatatttaccttagggtttctctgtgatcagttgtcattggggccattttttctttttacagttattgtaattatttgttggtacttgtctagttataaaaccagtatttgaatatttca

SEQ ID NO: 125 - DNA, 1110 bp, Pinus radiata
aagaattcggcacggctttttcaaagggtactactcatttaccccttcaaaattggcagttgcaatgaacggaggagttcagatctcttcatagaagacgccgcagcagcaaccagcacgcaaacactccatttagacaccaacactcctttcatttgccccacgaacgagagtctgtgtgctctgtggtcgagagagaagttttattattaaatggcgaggagaacggacgatgagtatgattatctattcaaggtggtcctgattggagattcaggagtagggaagtccaatctgctctccagattcacgcgcaatgaattctgcctcgagtccaaatctacaataggcgtggagttcgcaactcgcacagtgcaggttgaagggaagacaataaaagcacaaatctgggatactgctggccaggagcgatacagagcaattacaagtgcctattaccgtggtgctgttggggctttgctcgtttatgatattactaagcctacaacttttgagaatgttggaagatggttgaaggagcttagagaccatgcagactccaacatagtgattatgctagtaggtaacaaatctgatctaaagcatctacgaggcgtatcaacagaagacgctcagagttttgctgagaaagagggtctgtcatttttagagacatcagcgcttgaagctactaatgttgagagggcttttcaaacaattctggcagagatacacaggataatcagcaagaaggcccttgcctcagaggaggctgcaggagctggcatcagagaagggaaaactattcttgtctcagagcctgattctaatacaaagaaggcttgttgctcatagcaagattatataatgcctgaaaatatgatattagagcccaatctcatttttggtgagttttggttaggttttgtcgaatgattacttataacgatattttgctcattcttgatggtaacttacagttgcctcttttgtttagtattttgttgctgcaagctattatttgtttgaggagcaatggacatgacacctacatatttatttaaggtagggaatattttcagaagaaaaaaaaaaaaaaaaaaaaaaaaa

SEQ ID NO: 126 - DNA, 2510 bp, Pinus radiata
gttgtttgttgtttgattcttctgagagtaggccctgcgtgttctgagacttttttgtcgttttaatttctattgaacttggctcgtcatttgttcattttcaagtattgatttgatgtataggaggtgacaacttctgtaagtttttagatggatcaggaccaatccatctgcagatttgcagctcagaagggaaaaggagagattcagtcttcttcattcccagacgaagttttggaacatgttttggttttcctgtcctcccagaaggacagaaattctgtttccttggtatgcaaggcctggcacagggttgaggcgtggacgcgccagcaggtgttcattggcaactgttatgctgtctccccacagattatgataaaaaggtttcccaagatcaagtctgtctcactcaaggggaagcccagatttgcagattttaatttggtgccaccaaattggggggcccatctcactccatgggtgtcggccatggcaactgcttatccattacttgagaggctgtacttgaagaggatgactatcacagattatgatctcacattgcttgcaaattccttcctatatttcaaggagcttgttatggtttgttgtgatggattcagcacaggtggcctcgcttcgatcgcaagcaaatgcaggcaattgaccacacttgatttgaatgaggacgagatacatgataatggagaagattggctggcttgctttcctgagactttgacgtctctaagatctctttgttttgattgtttggagggcccagtaaattttgatgcactagaaagattagttgcaagatgcccctctctgaagaagctcaggctaaatagaaatgtttctatagtgcaattacaaaggttgataataaaagcaccacagcttactcatctaggaacaggctcatttttctatgagttccaactggagcaagtagcagatcttctcgcagccttcagcaattgtaaacaacttcaatgtttgtcaggatttcgtgaagttgtgccagagtatctacctgcggtatatccagtttgctctaatttaacatctctaaacttcagctatgctgttattggcagcagagagttggaaggaatagtctgtcactgtcgtaaattgcagctactctgggttttggattcggtaggagacaaaggtttggaggcagcagctacaacgtgcaaggatctgagggatctccgtgtatttcctgtggatgcacgtgaagacggtgaaggttgtgtatctgaacggggccttgttgcaatctccgaggggtgtccaaatcttgagtccattctatacttttgtcagcgtatgaccaataaagcagttgtgaccatgtcgcataactgttccaaacttgccagctttcgtctctgtatcatgggtcgacaccaacctgatcatttaactggtgaacctatggatgagggatttggggcaatcgtaagaaactgcaaaagcctaacaaggttggcagtatccggtctactcactgacaaagcatttcagtattttggagcctatggtgaaagattagagaccttatcagtagcatttgccggggaaagtgacctcagcatgaagtatgtgctcgatggatgcaagaaccttcggaagctggagattagagacagtccatttggagatgttgccctcttgtctggtttacatcactatgaaaatatgcggtttttgtggatgtctgattgcagactcactctacagggatgcacagagctggccaagaagatgcctggacttaatgttgaaataatcagagaaaatgaatgcaatgattctcttgttgagaaactttatgcttatcgcactgtagcaggtccacggaaagacatgccgtcatttgtaaccatcttatagccacttcacatgaatttcgtggttatggctctgctacatatgggcaacctgttagggctatcctactaaattaatcatgcatcaatgttactgatgaaaaagcccatgtccataatgcctttacttcaccaaaggaggagcaatagagcaggccaggttattgccattttactttggaaactttcttcaggttgtagctgccacctgaagggttggaagaatgtacgattcactgatgcagactgctaattcttgttgctccctaaagttgaatctagttaaatgccaaacaataaactggtgatagaaatgctgaaggtgatgaaaggtggagaattacagatgaatcccttctgcgtgcattggatagtgttttaagggactgaatgcctcaattggtctgtttgttttaatttcaaacaattgacctgtctttgatgcaatctgtgctttgacttgaattcaatctgtgatttgacttgaattttatttgctatatgactgatccggagcttgttgaggaggtttggaattgttccgagggaaaatttctgagtttatcatgttatactgattaattgcttgaattatcaaaaaaaaaa

SEQ ID NO: 127 - DNA, 2311 bp, Pinus radiata
ggaaagagcccacctggggctggctatttcattcattttgacgtcaattgccgcattacaacggcagccgagcagaacggaacgaaatcggcaatgcagatatctagcgagcgcagtcgatggcctgctgcttccctccattagccggtagacgacgacaaaccatttcccctccaaggaattcccgtcaagaagaagggcaatattgccgtcaagaagacgagcaatttccccttcaaggaatttccatcagaattcagccctgggggacaattggaggctcaggacggacagcggtttcgtaatccgcagcagaggtagatggggtaaatgcggttaaccggattccggtggcctcagctcaactcatgaaaaatttcagtcggatctgatctttctttttttcttttttctccctagatttttgtcactcgaggccgattcaaagggcgtcgtagctttggagatctcgagcgttcgagatatcgaacccgagcggcagcgatgcagcaggaccagaggcgaaagaactcttctgagatagaatttttcacagagtatggaggggctagtcgctacaagattcaggaggtgattggcaaaggaagctatggtgttgtatgctcagcaattgatacacatacaggggagaaagttgcaattaagaagataaccaatatttttgagcatttgtctgatgcaacccggattctacgggaaatcaaacttctcaggttgctgcgccatcctgacattgtagaaatcaagcatatcatgctacctccctcacagagagaattcaaagacatttatgtggtatttgaacttatggagtctgacctacaccaggttataaaggctaatgatgacttgacaccagaacattatcagttcttcctgtaccaacttcttcgagcattaaaatacatacacacagcaaatgtgtttcatcgggatctcaagccaaagaatgtccttgccaatgcggactgcaagctcaaaatttgtgactttggcttagcaagagttgccttcaatgacactcctacagcaatcttctggactgattatgttgctacacgatggtatcgggctcctgagttatgtggttcatttttctcaaagtatactcctgccattgatatttggagtattggttgcatatttgctgaagtcttgactggaaagccgcttttcccaggcaaaaatgttgttcatcagctagatttgatgacggatcttcttggcactccttccccagaaacaattgcaagggttcgtaatgaaaaagctagaagatacttgaatagcatgcgcaagaaacaacctgtaccttttacacaaaaatttgtgggtgcagatcatttagcacttaaacttttggaaagattgcttgcgtttgatccgaaggatcgtcctactgcagaagaggctttggccgatccttattttagggggttagcaaaagtagcccgagagcctgtagctcagccaataactaaaatggagttcgagtttgagagacggagggttacaaaagatgatgtgagagaacttatttatcgtgaaatacttgaatatcatccgcagataatgaaagaatacctgaatggaacagatcgcacaaactttatgtatcctagtgctgttgatcaatttaagagacagtttgctcacctggaggagcactatgggaaaggtggatcagttcctccattagaaaggcagcatgcatctttgccaagaccctgtgttgtctattcaaactctggtgggccctcatcagagcaggcatcttcaggtccttccagggatcgtgctttagaagttcgtgaagaagctccaaggtatagtagagaaggagagaagcagcaccaagacaggagctccggaaatgtgaaagtgcccttgcatgcaagtcataaagttttgcaaggaagtactgcaaaaccgggaaaagtaattggtcctgtattaccctgtgaaaatggaagcattaaagaagcatataatccaagaaggttgatcagaaatgctggtgttgcaccatctcagtgtcctgctccaatttattcctatccaagacgaaattccacagcgaaaactgaggttgatgataagagggaagatggaattaatcagtttaatgtatcacaacataagactcagtatgttggaattggtgcagcaaggaaagtggctgctcttgaaagcaggtcatctcatttgtattaaataaggtggattattaaatcgcgtatttttaacttatctaatatctatttactgactcgattctttaaaaaaaaaa

SEQ ID NO: 128 - DNA, 1229 bp, Pinus radiata
ctttcttcgacatctccgctctttagttaatgggtctctcatttcctgaacgtctaggcaggcctatccagaataaactagagcggaatatcatcttttgctttgctggaccgggatgtagaactcctgaacggtagccctcgctgcgaatttgatgtgctaggattcctttattagttgttgttacttagtgcttgaaagtggctttcctaggagtattttcttgttccaacaatcccagttagaaggatcattctacaatgaaaatttcatctcagcgatatgagagattgtgaaggtatttaaaaaacctcggagcagcgagaccaatccctcgcaaaatcccgaccagcaatcgaattacggcaatggcagacgatttgggagagttttacgttaggtactacgtgggtcacaagggcaaattcggccacgagtttctcgagttcgaattccgtcccgacggcaagctccgctatgcaaacaattcgaactacaagaacgacaccatgattcgcaaagaggtgttccttacacaggctgttctcagggaatgccgacgaatcattgccgaaagcgagataatgaaggaagacgataacaactggcctgagcctgatagggttggacgtcaggagctggaaatagttatggggaacgagcatatttcctttactacttccaaaataggatctcttgttgatgtccaaagtagcaaggatcccgaaggccttcggattttctattatcttgttcaggacctcaagtgctttgtgttctctctcattggtcttcacttcaaaattaagcctatctagccataaatggtggttgcatatacgtgcaaatgcatattatatgattgaagatttacattaaagagcacaatggatctttttgtacgctagtagctccggaaggattgattaacatggatgcgaagttttttttttttttttccaaatatttattaatactaaagagcataacatacctttctaaccgaggagatcccgatggactgatcacgatgtgtatgtgaagcgtgttttaaaacattagatttatcgtagtccagtcatttctataatttcgagttttagctcgtcggttgattcgtttgtgttcacgtgaattttgtgtggcttcttaactgttgtaattatccggcattccaagttgcattttttggtggcgcgttatgctcttgggtcataacacgtgggtga

SEQ ID NO: 129 - DNA, 1125 bp, Pinus radiata
ccttggtgttgggagcactgtccacggtaatcaaaatttcatctcagcgatatgagattgtaaagatatttcaaaacccttggagcagcgataccaatccctcgcaaaatagctgaaattggtatttacaaacccttggagcagcgataccaatccctcgcaaaatagctgagattggtatttacaaacccttggagcagcgataccaatccctcgcaaaatgcccccgaccagcgatcgaattccggcaatggcagatgatctgggagagttttacgttaggtactacgtgggtcacaagggcaaattcggccacgagtttctcgagtttgaatttcgtcccgacggcaagctccgctatgcaaacaattcgaactacaagaacgacaccatgatccgcaaagaggttttccttactcaggctgttctcagggaatgccgacggataattgccgaaagcgagataatgaaggaggacgataacaactggcctgagccggatagggttgggcgtcaggagctggaaatagttatggggaacgagcatatttcctttactacttccaaaataggatctcttgtcgatgtgcaaagtagcaaggatcccgaaggccttcggattttctattatcttgttcaggacctcaagtgttttgtgttctctctcattggtctgcacttcaaaattaagccaatctagacataaatggttgcatatacgtgcagatgcatattatatgatttgaagatttatattaaagagcacaatggatctttttgtacgctagtatctccggaaggactgattaacatggatgtgaagtcttttttccaaatatctattttgtactaaagagcataacatgcctttctaatcgagcagatattgatggactgaacacgatgtgtatatggagcgtgctttaaaacattagatttattttactccagtcatttctatatttttgagttttagctcgtcggttgattcgtttgtgttcacatgattcttttgtcgcttcttaactgttgtaattatctggcatttcaagttacattttttggtggggcgttatgctcgtgggtggatgtatactggtttttaacctttctctaaaaaaaaaa

SEQ ID NO: 130 - DNA, 1895 bp, Pinus radiata
gcgccagtccgggcacgaacgacaagaggaccatcaccgtttccgttccggacacggcgggagctccctctctccttcctccatttaaagggctgaagagaagtcgatcggtgtacgttgttgtcgtcaggttgcaggttcgaaccccatacccgctagccattgccagattgcacggcccacctgttcgacgtgcgtgacagtcttcaagtcaggtggctggtagattcacgattttcattttaagtgcggtgaacaggtaaaaacgcaaaaacgcatcgcaatcataattccatcgtgttggcaacccagctctcgccgaccagtgggaatgaccgaaagactgaaggtctagtttttggggttttggataaatttttgcgtttaacagggcggcatttgatttttctgctttaaaacggacattatagattggttcggttcagttttctggatctccgtgcttcggcccgcagagatccatgattagaaattcgtctcctatatctcctgcttgacggaaacactggaagtgtgaattgacgggaataaacgagtctctagagtctgctggttcatgatggggcacaacacttctgaagccatcaaacagatgaccgctttcatcgatggagtcgacgagccattgaagaagtctttccagactatgcatcgaggatatgcacagcaaactctagagaggtttctaaaggcacgggaagggaatgttcagaaagcaaacaaaatgttgctagattgcttaagttggagagttcaaaatcacattgataacatcttagcgaaacctatagaaccaagagaagtttataatgctgttcgggaatcacagctcatggggatgacagggtactgcaaaaagggacgtcctgtttttgctattggagtggggcttagtggatatgacaaagcatctgctgacaaatatgtgcagtcacatatacagataaatgagtaccgagaccaagttctattgccaaatgcatcaaagaaatatgggagctacattggaccatgcttgaaaatcttggacatgacggggctgaaactttctgctttaaaccgcattaagatattgactacgatagctacagttgatgaccttaattatccagagaagacggagacatattatattgttaatgctccatatgttttttctgcctgttggaaggttgtgaaacccttgttgcaagaaaggactagacgaaaagtacaggtgttgcaaggttgtggtagggaagagttactgaaggtaatggactatgatgttcttcctcatttcagcaggcaggagggctcagggtcatccaaacatcataatggcaagacgatagattgcttttctccagatcatccatttcatgtagaactttataattatattaaacagcaagcagcgattataaagcctgttgccccggaaaaaatgcgatcttttcatgtggatgttccagagcaggatgatgaaggaaccattattgtacagacactagaatctgcattacataatttaggtgatgaagaggcagttgagaatggtgttgctaatttgaatgtcaatggggatcaatctctgagacaccgaaaagcagctagaaatgaggttcaaggttgagtatgctgaaagtcgattggatatttaaataactggcccacatatctggaaatctgagttgacaatgtgtgacattgtgttgttatccttcagtatcagggttaatattgtatacaattctccagtttgacaatctgatctcaaactggtgttttgcctcataatgtaattgcattagattatcttattttgtgggagcggttgccactcccatattctgcaaaatgtcaaaaatgaaatccttattttaaaaaaaaaa

SEQ ID NO: 131 - DNA, 1793 bp, Pinus radiata
gggatagttgtgctccgaggaaagcattgaattggggataatggcggaaactgtcacatattcatggccggtgggtttcgtctgtttcgttctgacgatgttactacttcaactctacagaatagtgtggagggaggacagtcgaggctacaatttgcctcccggttccagtgggtggccattgattggagagaccttgagcttcatgcgagggattaattccatttctaaaccacgccaattcattcaagatcgagagcaaaggtatgggaagatattcagaacaaatttgtttggaagatctcgaatgattgtgtctgtggacccagaattcaacaagtatattctgcaacacgaaggcaggctggttcaatccagctatctgagaccttttcgaaaactcatcggcaaatacggtttgctttcggtgtacggagatctccagaagaagctccacggaacggccgtaaatttcctgaggttcgagaggctgagtgtgcacttcatggaggacatacagaaccttatgcacaccaccttcgcccagtggcaagccaaggggcatatccatctttatcatgagtgccatcagtttgttctgaacttgatggcaaaacaattgctggacttatcgccgtccaaggagacggaagagatcggtaaagcattcggcgatttttctaaatctttcgttgtccttcccattagaatcccgggtacagcgtactggaaaggattgaaggccagagattttctgatgaaaaagatttatgcgagtataaagtacagaagggagcatccagaagttgtccataatgatttcttaggagaactcttgaaagaagacttgcattccgaagaaattatagcagattttgtactattcctgctcttcgctggtcacgagacgtcagcctcaacgatggcatttgctatcaaatttctcacggactgtccccaggcacttcgggagctgaaggcggaacacaacgctctgttaaagagaaaggggagtccaagaaaccaaaacctcacttgggatgactaccagtcactgaaattcacccaatgtgtcataaatgaaacacatcgtctcgccaacgttgctccagcggttttcagagaagcaatagcagacattaaaattaaaggctttgtcatcccaaaagggtggtcagtcttggtgcttatgaatggcatccatttggacgacaagtaccattcttctccgctcaagtttgacccatggcgttggcaacagattctggaaaataatgagctctacaagaacccctcttttatgccatttggaggggggctcaggctctgtccaggaatgcatctggcaaaacttgagctgggcctctttctccatcacttcatcaccaaattcagatgggagccactagatgatgataagatctcctactttcctgtttcccacttgactaaaggctttccgatccgtctacatcctcaagaacaaatggatgattaatcgcagtataataggatttgattgatgcagtatggagtattagtaacagtaaataagtttgaaaaaatggataattaatcgcattataataggatttgattcatgcagtgtggagtattaaaaacagtaaataagtatgaagcttaaaacaataattgccccgctgtggacatataaatatcatgtccgttggtgtgagtagatatcatgtcagttggtgtgagtagatttcaaggatatttatgtatttcctgtattgaagcgtgaggataatgtattaaccataaaaaaaaaa

SEQ ID NO: 132 - DNA, 1061 bp, Pinus radiata
acacggagagggatcataagctcaaatgtcttcggcctgggagtgccgccacgaacaaaatggatcgactgagcaacggccaaaccacctgcaattcagtggagaaagggaacgatggaggtctgaatttcgataattcaatttccgacgcggtcagaaccaagctgaggcaaatgcgagatgtcattgagaaggaagatcccagctccaaggttacagatgatgatactcttcgacgtttcctgtatgctcgggaattgaatgtggagaaggcttctgtgatgttttcaaagtatcgaaaatggagacaaacttttgtaccccttgggtacatcccagagacaatgatccgtgatgagctcatgaaaaattctgtccacatgcaaggatttgacaaaagagggaggccaattgcagtcatctttctagcaaggcacatcccttgccgtaagacaatagaaaatttaaaatgtcattttgtctacattttcgataaaatgtctgctagttcaagaggacagacaaagtttaccattatagcagattttgatggttggacgtacaagaatgtagacattcgtggtgctattgcagtccttgaaatcttgcaggattactatccagaacgcttaggaaaggtgtaccttattcatcgaccatatatattttgggcagcatggaagattgtgtctcctttcatcgatcaagtaacaagggaaaagattgtttttgttgaagacaaacatttgaatgaaacactactaaatgatatcgatgaaagtcaacttcctgaaatctatggagggaaattgcctttagtaaaaattcaagattgtgttgtaccaaattggcccccaattacctccacataagaatatagaggaatttcaatatgatcttattgaagtatattaacccctatttggctattatattgtaatcttgaatccttccttaaaattatgtggtcctcttatatgaattgtaatgttcttaaaacataaaatgagaaaggaatgttaaatgaggaaactttcatttatattttaataaaaaaaaaa

SEQ ID NO: 133 - DNA, 1639 bp, Pinus radiata
ctttgctttgacgggaagacaggtatgttttctgcaagacccgatttgcttttatgagggcttttttaggcgtaatcgctttgtttggatcgcactggactataattgttcggtccttttccatttttttggctgtttaagaaccctgttgttcataatatttgttttctctttgcctcaaaccctttcagcgcttgtttgtttattggtatcagacctttttcgtgtttggttttctaaattaacgtataaattcatatcggattgcctctttttaaatctaattattggtttccaatttctggatttataatcttgttttgggctgcttttttattctggtggcttggccttttcagcatctctggagagaaaatgttattggtatcttcagtaacccccatggtagcaaagtcttccgtctttgctatctgttcgtcatctgaattcagggaacatctcctttcttctatcttcatttaaccctacaagggtttctgttaatgcaattcaaacaaactgtttgaattccggggctggggtttgtttcttttccctgtcctttataggaagaaaaggaaaaatgactggtgtagaatatgacgccagtgataaggacagggaaccctttgtggaagtggatcccactggcaggtatggtcgctatgaagatgtgttgggtcgtggtgccatgaagacggtatacagagcttttgaccaggaagatggtattgaggttgcttggaacaaggtgtctctgcaaaatcttgatgatgtttcccttgagaggatctattcagaagtccgtctgttgaagtctctcaggaatggaaacatcattatgttctacaatgcctggttggatagaaaaacagggcatgtgaatttcattaccgaagtttgcacctcgggtaccctgaggcagtaccgtcagaagcaccgccatgtctccatgaaggccgtgaagaactgggcacgccagatactggatggattgcattatctgcatagtcatatcccttgcataattcacagagatttgaattgcagcaacattttcgtgaatggaaatactggcattcttaagattggggatctgggtcttgctgctgccctggaaaatgatcatgctgcacacactattattggtacaccagaattcatggccccggaattatatgaagaggattacaatgagcttgtcgatgtttattcctttggcatgtgcttgctggagatggttactctggagattccttacagtgagtgccgtagcgttgctcaaatttataagaaggtgagttctggtataaggcccgcagcactggaaaaagttaccaatcaagaagtgaggcaatttattgaaaaatgtctggcagttacatcggcaaggccttctgctgccgaacttctgaaggacccattcctcagcgaagtacaatcgagtagctagtacatatgcatgtttgagtgctcaattattttaagattgagttgggggtttctgccagcgtctgtaggaactgttggtggaaatatgtgatgccaaatgctaggaaaaattatttagatattattgcatgtatctgtgggattttgattatttaaaattaagcaattatcgggattaaaaaaaaaa

SEQ ID NO: 134 - DNA, 3360 bp, Pinus radiata
gacaacttctgcaactcatacattaggaataccgtcttagcaacagcatcggctaccatcatgccgtattacgtgcttcaacgagaggttgaatcagaatttctggaggttgatcccactggtcgctatggccggtacaatgatgtgcttggcaagggagcatcgaagactgtatacagagcctttgatgaaatagaggggattgaagtggcgtggaaccaagtgaaagtgaatgatattctgcagtcacctgaggatctggagagactttattcagaggtccatcttctgaagactctgaagcacaagaatatcatcaaattcttttcatcatggatcgataccacgacaaggaacatcaactttattacagagatgttcacatctggtactcttaggcaatatagacaaaaacacaaacgtgtagacttaagagctgtgaagaattgggctcgtcagatcttgagagggcttctatacctgcacagccatgatcctcccataatacacagagatttgaagtgtgacaacatatttgtcaatgggaatcagggggaagttaagattggagaccttgggcttgctgcaattctgcgtaaatctcattcagctcacaccgttatcggaaccccggaattcatggcccctgagctgtacgacgaggaatataatgaattagttgacatctatgcatttgggatgtgcctattggaaatgctcacctttgagtatccttacagcgaatgctccaacccagctcagatctacaagaaagtaacatctgggaaaaaaccagcagctctgtacaaactgaaggatcctgaagtgagacagtttgttgagaaatgcttggtcactgtttccagaaggcttcctgcaagagagctcttaatggacccatttcttcagactgatgagcacggcttagaatattccttttccagattagatttctgcaaagatgatgtgggggaacttggcccgttattaagagaacctaacattgaagcttttcaaaatggtgctcataaattactccaaagcattcatcttgtgcatccttgtagcaagaatgagatttctgtccaccatgagaacaaaaaacaacaaaaggttgtacctttgccctcatacattagagaggacagtatgtctcacaacatggatttcactgtcaaaggcaagaagagggaggatgacacaatatttttaagacttcgaattgcagacactgaagggcgcattcgtaatatctatttcccatttgatgtggaagaagatacagccatgagtgtggccagtgaaatggttgcggagcttgaccttgctgatcaggatgttacaaagattgcagaaatgattgatgaagaaataatggcattggtacctgattggaaggcaggggtagcaatagatgatcaccattccttctatgaccattaccattcctccaacaaaacaagtgaaacttgctggtggaatcataacgatcatgcctccagtatctcttctcagagttccctgttggaatacctgaggtctcattaccacgttgacaacaaatcagaaatagtgccttgtactcaagttgaatgtgcagccatgcatggccggtttgaagaagtcacattccagtttaatgcaacagatttttattcatatgtagaagaggaggctcctacaatttcaagcggatcatcagatgttcttcatcacgattgggtgaatggagaggatccagtttcacctatatctttaatatcacatggttcagggattagcaattttgaagatccccaaacttgtctaatatcctcaggtactggtaacaaagaggatgtagttccaagcaaacctgcaaaacctccagaaactacaggatatgttggtaactttgaagaaagttggagcaatggattgtctgaagggttcagtcctgtcactgactctaattgtcttagctcagtccccaaacctatgttccatcctcaatcaccatcatcagtcaatattttatctgatgaagatgaagattccaccagcagagagttgcgacttttagcagtcaaacatcagaaggaattaatggaacttcaaagaaaacatgagcattccctcttaggaattgaaaatgaattgaaaaacagaacacctttgggaacatctttagatatgaaaaattccagtcctggaataaattttcaggatcagaaattgaacgtgaatgggcagcgagagcagcgggaagatgactcggttagacatggtacaactggtagggataaggagtttgtagccatgaaacaacttggatccgatgctcggggaacaaggctttccagcagtcccagtcatagattatcaccgatggaaccagcagtcagttctgatcttccaggtccaagtaaacttgcaatgcattcttctactctcccttctgttaggccaattaatagaaatatagcaccaaatcaaaggctaatgaaaatgcattcttttagtggtgttgacagtcagcgttctattaattctctggccaaagaagttagtaggcagaaaaattaccagacaattggagcatttcgaacaggaaatgtcgatgaaaagaaacatagtcttgaggggatgagacgatttccatctatatctcagaaatcttcttcaaggaactgcaaggaaggtaaaactaaaatagtctgagagaactgaagcacacttgtaacataaatttattgcccttagtttagaatatagattggatactgcactgaaaatttatcaattgtatatatgagctttaccttctggaagaggtaatggttggtggtaatgctatgcaaggttcttcggaaattattccttcgccttggcacctttatggtctcccaagaattttggtagtaagggcagcattttgaaattatacagaaacaaaggaaaaatgtatgcatcgtctttcattaggagaggctgcaactgccacgggctactacattgttgacatgtactatggattcaccagttcagctgatggtacaattcagatgaatttgtgggttataatccaaataagtgcttcttggctggatagaacccaattcctcaccagcttttccagttaacagagaattcatgtttttatggccttttaattttatgtcaagcttctgggaaaatttgtatctttgtagtattcaagattttacggagagcataagctataaaagcaaatcggtctgcagtgtattatcgacatcccattgttttcagaaatcgatcaataagataaggcggatgcagactagaagacatgcaagtattgcatgtctaaatggcttgattttctcatcaaaaaaaaaa

SEQ ID NO: 135 - DNA, 1719 bp, Pinus radiata
atgggatcgggcatcatgacggagactcttacagattcatggctagtgggcttgctctgtttagtgctgggcttcttactgcttcagctctacaaattagtgtggggggcgagcagtcgagcctataagttgccgccgggttctacagggtggccactgattggagaaaccatcggcttctttcgaggtattaattccactgctcaaccacgccagttcatccaagagcgagagcgaaggtatggggagatattcagatcaaatttgtttggaagatctcgaattgttgtgtccgtggatccagaattcaacaaacatgtcctgcaacacgaaggcaggcaatttcaggccaactatcccaaacctcttcgaaatctcattggcaaatatgggttgctttcggtacacggagatctccagaggaagttacatggggcggctgtaaatttgctgaggttcgagaggttgagcgtggacttcatggaggacatacagaaccttctgcacatcaccttggccaaatgggaagccaagagggatatacatcttcaagaagagtgccatcagcttgttctgaatttgatggccaaacaattgctggacttatcgccatccaaggacactgaagagatttgtgaagcgtttggccatttctctgaagctctcctcgctgttcccatcaaaatcccgggtaccaagtatgcaagaggatttaaggcgagggaatttttgataaaaaagatttacgagagtatagaggatagaaggcagcatccagaagctgtacataatgatttgttaacaaaactcttgaaagaagacacgttttcagaagaaattatagcagattttatactgttcctgctctttgctggtcacgagacatcgtccagatccatgtcattcgctatcaaatttctcacagactgtccccgagcactcgaggaacttaaggctgagcacgacgctctgttaatgaggaaggggaatctaaaaaatcaaaagctcaattgggatgattaccagtcgttgaaattcacccaatgtgtcatacatgaaacacttcgtgtgggcaactttggtccaggagttttcagagaaacaaaagaggacattaaaaccaaaggaggctttgtcattccaagaggatggacagtgtatgtgtttctgacaggcacccatctggacgagaagtaccattcttctgcactcaagtttgacccatggcgctggcaaccgcatctgcaagatcaagagctcttaaagaacccctcgtttatgccttttggaggaggtgccaggctctgtccaggaatgcatctggcaaagatggagctggccctctttcttcataacttcgtcaccaaattcagatgggaggcactgcaggatgataagatctcctactttccttttcctcgcttgatcaagggcctcccaatccgactacgtcttcgagagtgactagacgattaatgtaggatttaattcatgcaggctggagttaaaagaaaactatatagaataaaataattgccatgatgtggacgctagttccgatctaaatagcctgggtttgtgtgagtagatttcagagatatttatattagctttccttgtgtatcaaatcgtcgagattatcttcctctttgacttttatcgaggaagacaaatctattattttattattaataattttgaggtttatcaaaaaaaaaa

SEQ ID NO: 136 - DNA, 1925 bp, Pinus radiata
ggggaatgatcgttacggccaacataaaggagggagtggcattagcattcaaacgggtagcagttgttctgtgaagaaaaacattgcaatggcaataatgggggaaacccttcattcgttgctagtgggcctggtctgttttgcgctggggatgttactgcttgagctctacaaattagtgtggagggtggacagtcgcagctataagttgccgcccggttctacagggttgccattgattggagaaaccatcagtttcttccgaggcattaattccactgatcaaccacgacggtacattcaagaacgagagaaaaggtatggggaaatattcagatcaaatttgtttggaagatctcggattgttgtgtccgtgaatccagagttcaacaaacatgtcctgcagcacgaaggcaggcagtttcaagccaactatcccaaacctcttcgaaatcttatcggcaaatttggtttacttgcggtgcacggagatctccagaagaagctccacgggacggctgtaaatttgctgaggttcgagaggctgagtgtggatttcatgacggacatacagaaccttctgcacacaaccttgcccaaatggcaagcaaagagggatatccatcttcaagaggagtgccatcagcttgttctgaatttgatggcaaaacaattgatggacttatcgccttccaaggagaccgaggagatttgtgaggcgtttggccatttctccgaagctctcctcgccattcccctcagaatcccgggaaccgcgtatgccagaggatttaaggccagggaatttctgataaaaaggatttatgagggtatagaagacagaaggaagcatccacaagttgtccgtaatgacttgttaacaaaacttttgaaagaagactcgttttcagaagaacttatagcagattttatactattcctgctctttgctggtcacgagacctcgtccagatccatgtcattcgctatcaaatttctcacagattgtcccaaagcatatcaggaattgaaggctgagcacgacgctctgttacagagaaaagggaatcgaagaaacggaaatctcacttgggatgactaccagtcgatgaaattcacccaatgtatcataaatgaaacacttcgtctcggcaactttgctccaggggctttcagagaagcgaaagaagacgttaaaaccaaaggaggctttgtgattccaaaaggatggacggtgtatgtgtttctgacgggaacccatcttgacgagaagtaccattcttctgctctcacgtttaacccatggcgttggcagcaacttcttcaagatcaagagctctcaaagaacccctcgtttatgccttttgggggaggtgccaggctctgtcccggaatgcatctggcaaagcttgagctggctctcttccttcataacttcgtcaccaaattcaggtgggaggcactgcaggatgaaaagatctcctactttccttttcctcgcttgattaaaggccttccaatccgtctacatcctcaagagcgactcggcgattaatctcattgagataggatttaattcatgcagcatagataggatttaattcatgcagcatggagtgttaaaaagactagatttacttgaaggatagagcacttggcaccctgcggacacaagtcctaggtttaatcgcatatgttggcgtgactagatttgaacgctattaatatggcttttcttctgtctggatgtgtagggattagtcttcacttcccctctgattttcatggaggaaaactactgaaagtgctcagtgacattaattacttgtttttaatttttttaaagttttgtttggttttgtgatctaataagttattaagattacttttaaaattttgtatggtttttaagagctacaatgtta

SEQ ID NO: 137 - DNA, 2204 bp, Pinus radiata
gctacttccgaggacgcggacgaggagaaagaaaagagtttggaggtcccgggattaatttctctccgcgcatcgaaaacgaatttcgcctgcttctgcacagatccaggttcgaatcctcggggcttcaaagaggattcggacggactgaaatgcgagcaggagaacaggagcatcatcacacatatgggagggacggtagtagatagcgtccgtaggtggtatcagcgtcgctggagtcattcttcaagcgctcacgaatcaggaaaagagaaacaaacagttgattccctctcttcttcttcggtctctccattacctgtggaaaccaaggcggtggagggccgtggcttgaagcctgtgcgcgtgcagttgagaagcaaaatgaccgggcccgatcgctccaggaaaagctcgctggagacggagttcttcaccgaatatggtgaagcaaaccgataccagatacaggaggttgttggcaagggaagctatggtgtagtaagttctgcgattgatactcatactgacattgttgagattaagcacattatgcttcctccatctcgacgggaattcaaagatatatatgttgtatttgagttgatggagtctgatcttcaccaagttattaaagcaaatgacgatctcacacctgaacactatcagttctttctgtatcagcttcttagagctctaaagtacattcatacagcaaatgtatttcatcgtgacttgaagccaaaaaacattttggcaaatgctgactgcaaattgaaaatatgtgactttgggcttgctcgtgtctccttcaatgatgctccatctgccattttctggacggattatgtggcaaccaggtggtatcgagcccctgagctttgcggttctttctttactaagtacactcctgccattgatatctggagcataggatgcatatttgctgaaatgcttacaggaaaggcattgtttcctgggaagaatgttgtacatcaactggatatcatgactgatttgcttggcactccgtcaacagaaacactttctaggatccgcaatgagaaggccagaagatacttaagtaacatgcggaaaaaacagccaacacccttctcacagaagttcccaaatgtagatccacttgctcttcgtctgcttgagcgtatgcttgcatttgatccaaaagaccgacctacagcagaggaagcattagctgatccatatttcaatggtttggcaaaagttgagcgtgaaccttcaacgcagcctatttcaaagctggagtttgagtttgaaaggagaagattaacaaaggatgatgtgagagagcttatatatcgagagattttagagtatcatcctcaaatgctacaggagtatctatgtggtggcaacaatgccacctttatgtatccaagtgctgtagatatgttcaagagacaatttgctcatctagaggaacactatagtaaaggtgaaaacagcacaccccttgggaggcagcatgcctctttaccaagagagcgtgtcattgaattcagagagaatcctacaaagcacagcaaggattctgaaaaacaacaagaaagaatcactgcgtctgtaactaaggctacccttcaaagtccaccaagaaatcagggaattgtgattgattctgcagtttcactatctaatggtccaagtagagcagttccagatccacgaaacctagtgaagagtgctagcatcaatgcttccaagtgcacagttgttgtcaattcctgtcaaagaagaaactccacaatgaaacctggggatgagaaaaaggaggacttgagcagtgaatcgagtgctgtcacatacaatacagattcaatggttgctggtttgacaagtaagattgctgcaatgtccagtggagtggcacattcatgaatacttcattgtgttcaaatcattcagggcagtggttactaacctctaactgatttggttacaacatattctgaagtgtcctaagccaagcatagactgaatggctgctggcctggtaaagaaggttacagcgatacctagtggtttgccttattttcatgaatatgttaatggtcatctaatttttatattgtatcgattgtgacctgtttaaaaaatatattttactttaactggcttcttttgtgtaatcaataattaatctgtctcagtcaaaaaaaaaa

SEQ ID NO: 138 - DNA, 1140 bp, Pinus radiata
gtggcctgccttcccaaattgtacaatcattttaaacccaacatcctacaaataggatcatttggagcgtcatttcactcggtttttctctttcagtttgaagcggtggagaaatggtctgtaggcaaactaaccatttctgaagagcaggccttagaattgtagggtaatttgcagtggacaagatggcttacagagcagatgatgactatgattatctcttcaaggtggtactgattggggactctggtgtgggcaagtccaatctgctgtcgagatttactaggaatgagttcagtttggagtccaaatccaccatcggagtggagttcgcgactcggagtataacagtcgatgataaggtcataaaagctcagatttgggacacagctggtcaagaaagataccgggccataacaagtgcatattatcgaggagcagttggtgcactgttagtttatgatgtaactagacatgtaacctttgagaacgtggagagatggcttaaggagcttagagaccacactgatgccaatattgtcataatgcttgttggtaacaaggctgatttgcgccatcttagagctgtttctatagaggatggaaaagcatttgcagaacgagaaaatacatattttatggaaacatcagctttggaatcaacaaatgttgagaatgcattcacagaagtacttagccagatttaccggattgtgagtaagaaagctcttgatgttggggaagacccagcagcggtgcccagtaaagggcagacgatacatgttggcaataaggatgatgtgacagcaatgaagaaagttgggtgttgttctttataagcccaaagtgcagtgctctaaagtgttgtcgtctgaagcttttgcttctaaagcgattctttttgaggaattgatttaaatgtcaaaagaaggattgatggttgcatgtcagttttaagagacaagcaccctgctattgctctgtatgatttattagtgaacctttgctgctcttggatgcctccaaagcgcattgttgtcatatagcttttgttgctactatacgttttagcaaatatttcaatgatttgtattgtggttattttggacagatcatgtcaaaaaaaaaaaaaaaaaaaaa

SEQ ID NO: 139 - DNA, 3149 bp, Pinus radiata
aagtcttagttgactccacccacccctgggccagcttcgaatctttcatatgtgataaatcaggcgagacttaccataagtaagcctaaacgcatttatatcaaagtttcacctgagagttccccagtggacacttactcaaaatatgagtttatcaaagttctacctgtggattctccaattcacccttaatcaacccatcccaaaataattgggagtttctgagtatctagggtgagtgggtgactccattcatctctctgacagatgacagatgaggttaagatgctgttgttggtgctgccgctgccattagcattgggtttcgttgtgctaggctggaatctggatgtggccttattttaatgaagcccccgtatcccgatggtcttcactctctcggccccgctgggcatccttcataaatatctatgttcgctgtaacaaattgctcaggcctgtgaccaaggggaaatggagcccacgcccagcgctcgtaattagctcgaactaagaaccaaagtgtggaccatctgaccatccatccattcattgcctctccggctctggaagtttgaggggggcgagatttgtccactagaccaacgtggattcgggataggctgttgttttcgagagatctgaaacagcgggggctgcaggaatggaactggagacctcctactgaaggccaacagtgcgaaggggttcggaatgatgaagaagagaggggattcttcgtcttcattcccagacgaggtgctggagcacgtgttgttgttcgtggtttcgatcaaggacaggagcgcggtttcgctggtatgcaaggcctggtacagagccgaggcctggagccgccggaaggtcttcattggaaactgttattccgtctcgccggagatcttggtgaggcgcttcccaaagataacaggcataactctcaaaggaaagccgcgcttctcagatttcaacctcgttcctccccactggggggcggatattcacccctggctcctggtcatacgcggggcctatccatggctccgggagctgaggcttaagcgcatgatcgtcacggatgaaagccttgagctcatagcgcgttccttctccgatttccgcgctctctcgctcaccacttgcgaaggtttcagcaccgacggcctcgcagtcatcgcaactcattgcaggaacctgcaagagttggacctgcaggagagtgaggtagatgatcgaggcggttactggctgagctgttttccagagagctgtgtttcactagtgtcactgaattttgcttgcttgcaaagtgaagtgaattttgatgcccttcagaggcttgtggctagatgtatttctttgaggagtttgaaactaaataaaactctttctttagaacaattgaagcggcttcttgtaatagctcctcagctgatggagctgggtacaggttcattttttcaagagctcagtggtccgcaatttactacagatctggaaaatgcttttaagaactgtaacaaacttagaactttgtcagggatgtgggaagtagcacctctgtatcttcctgccttgtattctgtgtgctcaaacttgacatttttgaatttaagctatgcggccaatatccgaagtatggagctgggccgtcttgtttctcattgtcctcaactccggcggctttgggttcttgatactgttggagacaagggtctggaaaccgtatcatcaaactgtaagaacttgagagaattgcgggtttttccattggatccatttggccaggatcgagttggtgtcacagaaaaaggcatccttaaaatatctcaaggatgccctaatcttagttatgttttgtatttctgtaggcaaatgacaaatgcagcaattattgaagtggctcaaaattgccccaggttaacacattttcgcctttgtataatgaatccctgccagccagatcatttgacagatgaacctatggacgaggcttttggagcaattgtaaagatatgtaagggattacaacgattggcaatatcaggtttgcttactgataaggcttttgagtacattggtctttatgcaaagaatctagaaaccttgtctgtggcctttgctggaagtagtgatttgggcatggaatgtgtattgcggggatgtccaaagcttcggaagcttgagataagggatagtccatttggcaatgctgccctcctatcaggtcttgaacaatatgaatccatgcgttcattatggatgtcttcttgcaaggttacgatgagtggttgtagataccttgctcagaacaagcccaggcttaatgtggaaataataaaggaaaacgatgaagatgacaatgatgcagacaaattatatgtctatcggacaattgctgggccaagaagggatgctccaaattttgtgctcaccttatgatcagattcttcttttcatcgttatggacagtctggttagctgcctggattatcatgaaatgattacagggaagaatcatcttgtatatatctgtgacttgctcaacatgtaggatgggatacctgctgaattgagacacaccattgtaaggcaaggcatctgtcattagatgtggatgactgttggttttttctcattggtgtgtactatccattaaaggtggcaccaccaattcgtcagatttgagtccttcgtttatcggactcacaagtttcatttcataataggtctaatcttggttaacttgtgagtccctcgtgccgaattcggcacgaggacggactgtgctgctggaaaaactcgtgttttcgtaaatggtagggagctccatcaaaaagacttggatttgcttgctggcagaggtctaccaaccacaaaagacaagtattaccacgttgagatcagcggaagagttgtggataaggatactaataaagagctgaagagtcttggcaagcttgcaccaacgtaggtcaccagttaatatgcattcttctttcagaaattcaaggaagtagagcaaattttattttccagtatgtcaaatttggctttgggctaccaggtttttgtaattgatgtttgaaaagttatacatgtttttcaatgcatttccgggcaataacacttctcgtgccgaatcggca

SEQ ID NO: 140 - DNA, 1046 bp, Pinus radiata
cataactacaaaccgtaacgcatgcctggagcagtgtccataacgtcagtacggtcgtgagcagcaggaaactttttccgtgctccttctcacatcttcttgtttgcttcgggattcgatatcctgaccactttactcatcagcccgctgaattcttctctagacttgctcttttcctgtcattgagggccaacacagccaacggcttcgttcaaaatcgggccacaagaatggtcgatcactcgctcatttacagttttgtttcgagagggacggtcatattggccgagtacacggaatttactgggaattttcccaccatagctttccagtgcctccagaagctcccggccaccagcaataagttcacatttgactgtcaacaccacacctttaattatctcgttgaagatggatttacatattgtgtcgtggcagatgaatcagctggaagacaagtaccgatggccttcctggagcgcattaaagatgagtttaagaagacgtatagtgatggaagagctgaagtagctattgccaacggtcttcaccaggaatttgggccaaaattgaaagaacacatggactattgtgcacagcatccagaacagatcaataagttagccaaaaccaaggctcaggttgcagaggtcaaaggcgttatgatggacaatattgaaaagatccttgatcgtggtgagaagatagaactgatggttgataaaacagagcaacttcaattccaggctcaggattttcagaatcagggtgctaagatacgcaggaaaatgtggttccggaatacaaaagtcaagctaatttgtcttagtttcttgctttttgtagttctcatgatatggatctctctatgccgtggattcaaatgccatgtctgaactaataagtttgtagctatcaacatgactaagctttagtgaagggctatacaatgcatctttattcttctattgttgttctctctacatgtaaatggtgtttgctggaaaggtaattctttttcctgtttcttcagagtaaaaaaaaaa

SEQ ID NO: 141 - DNA, 1463 bp, Pinus radiata
ctgcaatgtccggtctcatcctttttcaatcaattccattgccatttccctcccaaacccaaagcatagggtttccttcatctcggcggatctcgagttcaatcccttctgcccatgaatttttgcctttttcgatcccatagttgaagctcgacgcaggacgaacagatcggggcaattaacatacttattcattcggactttcattcgcttcaaacatcggtggttcgaacgccggggcgtctggatatagcagcaaaaagattacgcaaaggcagcggctctcatggcgatactgtatgccctggtagcccgtggttccacagttttagcggaatttgacgcggctcacggcaatgcgaaaaccatagcgcgtcaaattctggagaaaattccaggtaccggggacagccacgtctcttattcgcaggatcgctatatttttcatgtcaagaggactgatggattgacagttctatgtatggctgacgatacagccggaaggaggattccttttgcatttctagaggatattcatggaaaatttgtgaagacttatggtcgagctgttcatacggcacttgcttttactatgaatgatgaattctcaagagtcctgagtcagcagatggaatattattcaagtgatccaaatgcagacaagattaatcgtatacgaggagaaatgagccaggttcgcaatgtaatggtggagaatattgacaaagtactcgagagaggtgacagattagagttgctggtagataagactgaaacgatacaagggaatactttcaaatttaagaagcaagctcgtcgtttcaaaaatacaatgtggtggagaaacatcaaactcacggtcgcagtgatagtcgtgcttttgatcgtcatctatgtcatcctcgctatagtttgcaaaggtgttacactaccgtcctgcagaaagtgaatcgaaccgtttgaatttgtggtcagtgtcgtgtgtatttttagaaggcacaaaggtttttattttgggaggctattggttaatacatataaagggtggtaaagcgctgttcatatttttcctagaagtattggtcattttctgtgtaaattagattcattgccgtcaaagaaatgaagattatttggaacatgaggaaacatatttttttccaggctttgagcacaagcattactcttatggtaatgacatggcatggaagattaacaaacatgatttttattatctatatttattctgttatcagttcaagcactcggaatatttgttcatgagcctttttcatttagtttggaagtgatcatttgtaacagttttttgacacttttgaattgttttgtaagatgtgcccatctactttatcggaagaagggagacactcttactcatctttggatattttcagtaatttttaataatagatcagagagttcaagatggattaaaaaaaaaa

SEQ ID NO: 142 - DNA, 1379 bp, Pinus radiata
ggaagaactttgcgtttccctgcatttctacttgtacccttattcattcattcaagaaaagaaaagggcaatggctgtagttgcttccaattctctacaactgcagcgtgaagaggaggcagagacgatgatatcagatcaacagcaagaagctggggcggagataatggcatcagaagaagagtcgattatggaaccagaaaacccgtcattgtctcatcccaatattgtgtccagctgcgggatgaggttccaaaagtaccagagtgtttggattgacgccaacttagtccccgcagtgaatttcatccaaaacgaatttcaaccacgccccgacgacatttttttcgcttcccttccaaagactggaaccacatggggtaaggcgttgctgtataccatcttggaatttacttccacaggcaataaccctccagcaagcccgaatggtaattctgctgcggatgagaaaagatttggtgtggatgagaaaaatccgcatgctttggtcccaaccatggaaacttatctcttcaattcaagtgacagcgaacagtatgatatttcctgcttctctgattttccgtctccgcgtgtgctccacacacatttgccaatccatacgctgcctcttcttgtgagatcttctccgacttgcaagatagtttacattgcccgcaaccccagagattccttcgtttccctttggcaattctacgccagacttcgcggagcggggtctcattatttggacggagatctcggcaaggaaacggtgtttgatgcattttgctctggcttctactatggcggcccctttgccgagaacgttctgagttactggcatgaaagcaggcgcaatccgaatcaggtgatgtttgtgacgtacgaggacctgcaggccgattgcgtgggatgggttaaaagaatggctcttttcttgggttgctcttctcctcttctggaagacaacgcccagataattgcagaaaagtgcagtttcgataccctctgcaatctgcaggtgaacagaaaaggaaaagtggggacgcttaaatacggaatgaaaaacgccttcttcttccgcgagggcaaagtgggcgagtggaagaagcattttacgccacagatggaggagcgtatttatttagagatcgagcagaaattgagcgatcaaggccttcgtttcactaatagcttgtagaaagccatttcgtttgtgttgaatttatattagctagatagctatcaggtcctcggattctgaaatcttcctgaactctacagttaagataaagaagtcacatccatttccatctacttattacttttattgaccatcagttgcagtgaagttccttagtgcaataaaaaaaaaa

SEQ ID NO: 143 - DNA, 1097 bp, Pinus radiata
ttgggttcggggtcctgtcctggactgggaatttttgtttcactcgttctgccccgtctggattgggctgcactgaaatacattgaacattggagttgtcgagcgcgagatatgggtcagcagtccctcatttacagctttgttgcaaggggcacggtggtcttggccgagtacacccaattcacgggcaatttcacaacaattgccaatcaatgccttcagaagattcctgccagcaataataagttcacctacaattgcgatcgtcacacattcaattatctcgtcgaagatggttacacatactgtgttgttgcagatgaatcagttggaagacaactaccaattgcctttctggagcgcattaaggatgacttcaagaaacgatatggtggtggaaaagctgacacagctgttgctcacagcctcaacaaagactttggaccaaaattgaaagatcatatgcagtattgtgttgatcacccagaagagattaacaaacttgcaaaagtgaaggctcaggtttctgaagttaaaggcgtaatgatggagaatattgagaaggtccttgatcggggtgaaaagatagaacttttggttgacaaaacagagaaccttcgatttcaggctcaagacttccagaagcagggaacacaacttcgccgaaaaatgtggtttcagaacatgaaagtcaaactggttgttcttggaattgtctttgtgttgattcttataatctggctctcaatttgccatggatttaagtgccattaatcttgattacttggcagtcctttctagatacaatcctttcgaggcatttatattcattttttggcagcttggcttataatagatgcaggctctctttgaaaagagtatcttttgtgttgtgtctgagtaatgtatttcattcacttggatactctcatcattagatactgattatctatgtttttctctgacgagggacaatgcctcgactcttcatagtttaggttattggcactacccatcagctgtgatgtcaatctcttttataaatatgaatccctgcttttggttttcaaaaaaaaaaaaaaaaaaaaaaaaaaaaa

SEQ ID NO: 144 - DNA, 2618 bp, Pinus radiata
gcatatgcgaatagcacatcaaatcgggttgcgactgcctgccacgttcgatatctcaggctcttcgatgaagctgagtgccagaatcaaatttaataatcaatgaataataacaagggaaattactgtagattgcgagacgttacagtttacttaggatgaccccaatgatttctcatctttgcttcaattcagtgtcgcagagggtgctcttccatgtctgaagaaaaatgtgaatgatgctctgcaatacaaaattttctcgcattgtggacgcgtggtaagtgcaagaaacgagtgaaggggagaagggggggttttgcctgtaagaaaggatcagagagagcaagcatccagtagccatggaaaacatgaggaagaagttggggccactgttcaactccgggcagagtttccgtcctgacatctctgttgattcctgtacttcatataaggtaacagcgggtggaactttacacttgctgagtaattcgtgtggagaatataatattaatgaacttggcttacaaaagcgcacttcagcaggtattgatgaatatgatacgaatgagaaaacatatcagtgtgcttcgcatgagatgtgcatatttggtgtcattggacgtggtgcaagcagtgttgtccaaaaggctattcatataccaactcatcggattttagcactgaagaaaataaatacttttgagaaggaaaaacggcaccagctattaaatgagattcgaacactatgtgaggcaccacatgtgaaaggcttagtggagtttcatggggctttttacactcctgcatctggacaaatcagcattgctttagaatacatggatggaggctcacttagagatcttgtgcagtcaaagaagcgtattcctgagccaattctttctgttattacacatgaaattttacatggattaatttttttacatcacgtgaggcatctggtgcatagggacataaaacctgctaatctgcttataaaccttaatggagagccaaaaattacagattttggcattagtgttggtttggagaacaccgttgcaatgtgtggcacatttgttgggaccgtcacatacatgtcaccagagagaattggtaatgaatattattcattcccagcagatatctggagcctaggactttccatttttgaatgtggtacaggagagttcccatacaatgcaagcaagggccctgtgaatctcatgctacaggtcatagatgatccatctccctcaccttcacgagattgcttttcagaggagttttgctcatttgttgatgtctgtctacagaaggatccaactgcaaggcctacagcagaacagctcttatcacatccctttattaaaaaatatgaaaatgcaggagttgatctgtcagcatatgtacaaagtatttttgatcctatagaccgtctaaaggatttagctgatatgcttactgtacattattacatgctttttgatggcaccgatgatcagtggcatcacatgaaaactatgtaccgtgagaattctgctttcagctatgcaaaccaggttgcagctggagcaaatgatatctttaatactctatcacgaatacatagcatgttggttggtgatagccctgatgaaaggcttgttcatgtagttgaaaatcttcaatgctgtgtatatgggcaacatggtgttgtgatccgtgtatctggatcatttgttcttggaggccagtttataccaactgggggtggggtgcaagttgagggggtttcacaaggacctttgttggacatagcatcacaaagaatggggacctttaatgagcaattcatcatggaaccaggagagcagattggatgttattatatatataagcaggagctgtgcatccaacagtgaaaaaaatgcatacaaccaaattgtctttttgcttccgtacagtctatattctctggtacaggagtgctgtaaaaaagcagcccaagaacaggaagcttgtgaagggagtttccatcatagcagttgtagcaggggttggaagattccttgatgttataacttgtatgcaccatgtatcaccatcaaagaaaacccacatctgccttcagattgattgactgggaagtaaaacaggcatgggagacaacttactggaagcagatgaacagctaatatttcagtgaagatttgctcaagagattattagagactgatgaactaataactctaaacagatcaatacatcactgaagtttgtgttgcaaccctcatgaagatggagaatagcctatgcatattttgatgcatctatagtttactaaatttggaatctgtagctgttgtgatggtgttctgattagagtagctttatgcagccttgagataattttaaatggctgagagttttgttgataaagaggaagagtaatactgttgcctcaatgactgaataaggtaaagaattgtgatagttggacaaaaaggtttggtagtttaaaggcaaacacttgcagttgtcatggtatgggccttcttaaaaaggttgttatcatgtcagatgccattactcgatgctttctaatgtttggttagtataaagatctaaaaaaaaaa

SEQ ID NO: 145 - DNA, 2540 bp, Pinus radiata
aaacgcggccgattttaccggacgggcgaaatcaccatgatcgatagacacagttcgaggtgaatggaagcttcgccgttgatccaagccacctccgtggagtgacgtgtattgtcttgacttatagctgtacaaaagaaagaagtatcgaggaaaatccgataaatataaaattcaggttcaaattctcaggaaatagcttaaatttcgctttcgatcgctatcagagccttgaaagttcagaaaagattgaaaacgcggtcttttggcaaattgaagaaacggaaatacttcggaaggattcggtaatcccgcacgtttgacattcttaggtcaaggcttaaagttttgtggctatgcatggggataacttgctttcaggtgattgaaaattgaaaatttactaaactttgatggctttgttttgaggctcggcgaattgatctttacggtgctttatgtgagaaattctgtggaaaaatctggtcttcagagatctttaatggtttttcctgaagaaatgatcatgctccaaaaggattccacagttctgcatttcttagctgaagcctaacagctttccgggtatgcatcggaaatatcttggtttcatttgctgaaaattttcaaaatttactgaaattcgaaggatttgttttgaggctcagtgagttgatcttaacggtgttctttgtgagaaattctgtgggacaaattggactcgagagacatttaatggtttttgctacagaattgtggaattatctcgtgtgaccttaaaggctcttgcggtcttcgttcttgcacgaattttggctaaaactgctgaaagaagtccagtttcaacgcatttaagaaaactactcaaacatcggtgaattcagtggagtcttccaatcgaggaggctgcaacaagaaattgttcctgctgggactatttatatcggcaaattaaccgaagttgtgaggatatggaattggttcggaaatagttcattagcgggacaatttgacaggaatcatcaagctaagcttttgcttggaacgcttataaaattttctgttaaagatcggtcaattttgaactccggcagataaaggtctggtttgtggtgtggagcggaggcggctgctgttgcagttaaatctaacgatccggtaatggcccagacagcccaaccagctttagatcccaatattcccggcgttcttactcatggaggccggtttgtgcagtataatatttatggcaacatgtttgaagttaccgcaaaatatgtccctcccctatttcctattggacgaggagcatacggtgtggtctgctcagcactgaattcagaaaccaatgagcaagttgcattaaaaaaaatatccaatgcctttgacaatttaatagatgcaaggcggaccctacgagaaataaaactgcttcgacacatgcagcatgaaaatgttatttccatcaaggacataatgcttccccctcaacgagaagcttttgatgacgtgtacattgcattggagttaatggatactgatctccatcaaattatccgttcaaatcaggctttaagcgagcaacattgccagtactttttgtatcagatattgcgaggattaaaatatatacattctgcaaatgtcctgcatagggacttgaagcccagcaatcttcttctgagtgcaaattgtgatctcaaaatagctgattttggactagcccgaactacatctgaaactgacttcatgacagagtatgtggttacacgatggtatagagccccagaattgttattgaattcaccagattatactgcagctattgatgtgtggtcagtaggttgcattttcatggaattgatgaataggaaacccttatttcccggcaaagatcatgtgcatcagctccgtttaataacagagttaactggtaccccaactgatgctgatctaggttttattcggagcgaaaatgcaaaacgacttgttcagctgttgcctcaacttccaagacaatcattagctgaaaagtttccacatgtacatccttcagctatagacatttgtgaaagaatgttaacatttgatccaaaccagagaattacagtggaggaagcattaaatcatccttacctgggtagtctgcatgatgaaactgatgagcctacctgtccagttccattcaactttgactttgagcagtatgcattgacagaagaacagatgagagagctgatatacatggaggctcttgcattcaatccaacttagaagactgagtggtggtcttttttcttgtttcagattgcacaactggttgttttgtttgatattaagataaatgtttgatttaaattttgagctgttattctccagttgagaagcatgttaccttgcacaaaggaaaatcaatatataaaacataaatttgatatttgaacagcaatatgccagaacctactaaactggatgctaaatgagccagacgttccaaataatagacagttaactaacaccattatttagtaaaaaaaaaa

SEQ ID NO: 146 - DNA, 2312 bp, Pinus radiata
gaaagatgagtgatcatcggcctgtgtcaaggtgcctagagaggtaatgggaattggaaatatttataatagtaatggtaattggaaattgacagagaggacgcgttaggcttttaggcagccatgaagagatgtgagggatgcttcgaggtcggcaggttggaggccctaggcgacgacattctgctgcaggttcttgacaatattaacgaaactcgagacaggaattcatggtctcttgtctgcaaacagttctatcgactcgaatcggcctacaagaggaaaatccggttgctcagaggcgaaatgctgccaagaattctcaagagataccgagctgtagagcacctggacttgtccctctgccctcagatcagcgatcagtgcctggggttcgtggccgcagcggctgggtctagtctgcgctccatagatctttcgaggctcgtccggtttagtcatctggggctctccgttctggctaagggctgcgagaatctggtggagattgatgtttcttactgcgcgagatttggggatatggaggctgctgccgtttccagtgccaagaatctgcagaccctgaaattagtgaggtgccagatggtttctgacttgggtttgagcttaatagccgtggggtgcaggaagctccagaatttgaatctcaaatggtgtgtgggagttagtgatttgggtgttgagctcgtggctataaagtgcaaagaattgaggtccctggatgtttcttacttacagataacaaacaaatgtattgcatccatcacacaacttttttacctagaaacttttgtatcagttggttgtgtctgtatagatgacgaaggccttgctttgctcaagaatggttgcaaatcattgcagaggcttgatgtttcgaaatgtcagagtatgagttcgactggtataatttcccttgcaaacggatgtatagccttgcagcaactaaacttagcctattgcatccctgtcacaaatgctcttcttgcgagcttcgacaaatatgacagcctgcaatccatacgatttgatggctgtgaaatttctagctcaggtttgaagtctattgggaaaagctgcaagtctctgatggaattgagcttaagcaagtgtactggggtgacagatgaaggaatctctgcactagtgggaggctgtacagggttgaaaattctagatatcacctgttgccgtgatctcactgatgttgctatcacagctgttgcaacatcctgtggaaatctttcatgtcttaagatggaatcctgtgccctggtcactgagagaagcttatatatgctgggagatagctgcccctttctagaagtactagatctcaccgattgtagtgtaagcaatacaggactgaaatccatttccaggtgcactggattgactaccttgaaactaggcctatgcgaaaatatatccaatgagggtttaacccatattgctgctcactgttcaaacctccaagagattgatttatacaggtctgtgggaattggtgatactggattagcagcacttgccagtggttgtccaaagctcagaatggtcaatctctcatattgtataggtatcacagatcatgggctgaaatctctggcccaactagaaaaactttacaaccttgagattcggggttgcttccttgtaacatctgcagggatttctgccattgcctcgggatgtaagcgtctggtagagttggatatcaagaggtgctaccgtgttgatgatatgggaatgatgactgtagttcaatgttgcataaacttgagacagataaatgtttcatactgtccaatttcagatgctgcctttttggcattggtgaatcttagttgcttgcaaaacgtgaatctagtgcatctcagaaatgtttctttggatgcctttgcatatcttttgctagcttgtgagagcctaaagaaaatcaagcttttgaaacaattaaaatccttactttcatccaatttaattagacatgtagaaaataaaggctgcagaatccgatgggtggagaagcctctttttatttaattgtagaaaatagctaaactttgatccatgaagacctcttaatccatggtgagagcatgaggtctaataagttcggaaccgtgtattcatcatctcaaaattgcaaaagaattttcaagtcctggttttttgaccagaaattttgtaaggtaagttcttgtctatatgaaactttttattaggatatttaagtttcaatgggtaatattaagtttcaatgctaaaactttttatcaaaaaaaaaa

SEQ ID NO: 147 - DNA, 1672 bp, Pinus radiata
gtcaagggttcgatctacgctcggacatctttggctctgtttccctcagatttcagtgatggaggccgcagcagctccagttcaatcgacggacacgctcatgtccgacgcgccgcaggccgccgggtcgaatcccatggacagcatccctgcagtactcagtcacggtggccgcttcgtgcagtataatatctttgggaatatttttgaagtcacagccaagtacaaaccacctctgctgcctatcgggaaaggggcttacgggatcgtctgttctgcaatgaactctgagacaaaagagcaagttgccataaaaaagatagccaatgcctttgacaatcgcatagatgcaaagcgaactcttcgggaaatcaagttgctccgacatatggatcatgaaaatgtagttgccataagagacataatacctcctccacaaagagaagcctttgatgatgtatacattgcatatgagttaatggatactgatctccatcaaattattcgctccaatcaaggcttatctgaggagcactgtcagtactttttgtatcagattttgcgaggattgaaatatatacactctgcaaatgtccttcatagggacttgaagcccagcaatcttctactgaatgcaaattgtgatctgaagatatgtgattttgggctggctcggattacttctgaaaccgatttcatgaccgaatatgtggttaccagatggtatagagctccagaattgctgctgaattctgcagattatactgcagccattgatgtctggtcagtaggctgtattttcatggaattgatgaacagacaacccttattccctggaagggatcatgtgcatcagctgcgtttattgacagagttgattggcacaccaactgaggctgaccttggatttgttcggagtgataatgctagaagatttattcggcaactgccacagtatccgaggcagtcatttactcaaaaatttcctcacgtgcatgcattagcaattgatctttgtgaaaaaatgctgacatttgatccaaatcagaggatcacagtggaagaggcacttgcccatccgtacctggcaaatctacatgatatcagtgatgaacccatttgtgccatgccattcagctttgattttgagcagcataccttaacagaggatcagatgaaagagctgatctatagagaggctctggtttttaatccagagtatgcacagtaaagtaacattttgtgcagacagtggttacaactttgaaaattggaagctgggctattttcttgtttgtagcagtcatagtgttataaatatttattgagttttgggagcaatgtaaatatgtgtattaaaaccacatttgagtccagggcaagttgtaagggggataatgattgaaggggtgtaaagcatttatattggagtatgtcaacctgatatgctacaacttggtgagatgcattgtgcatgtatgagtcacagacctgaacactgcggtaaaactgtattatgctttattcttctttatcttcaaacttcaaggggttgtatgaagataatttttgttagaatataagtgaagaaaagttgagtctggcagtttgccacttttgtctaattctcctttcagataagtgatgaacttggacctttggctattgtgta

SEQ ID NO: 148 - DNA, 1639 bp, Pinus radiata
gttgaagaagataaaaaatggcaaagaagcaggcagggaagagcaacgatagcactgtgaatgacagtggaagtgaaaatgagacgaagaaacccgccggttcgaaggaggatgggagtattcattctcctctggttgcatacgcctccattctcagccttctctcatgtacccctccattcgtcatattcctgtggtatacaatggttcacttggatggatctgcatctcaattttgggatttatgcaaggagcaaggtcttcagggtttcctaagaatctggccaaaaccaactctcatagcatggaaactaattgcatcatttgcagcttttgaagcagcactccaactacttttacctggtgaaagagtaactggacctgtttctcctgcaggaaacattccagtctataaggcaaacggagtgctggcttactttgtcacattgacaacttatattgctatctggtggtttggcctatttaatcctgcaattgtctatgaccacttgggagagatcttctcagcacttatcataggcagctttatcttttgcatctttttatatattaagggacatgttgcaccgtcttcgactgattcaggctcctctggaaatgtagttattgatttctattggggtatggagctttatcctcgaataggtaaaaactttgacatcaaggtcttcacaaattgtcggtttggaatgatgtcttgggcagttcttgcagtaacatacagcataaaacagtatgaagagtatggaagagtagcggattccatgttagtaagcagtatattgatggtggtgtatgtaacaaagttcttcttgtgggaatctggctactggaacaccatggatatagctcatgatcgagctggattttacatttgttggggatgtctagtttgggttccatctgtatatacatctccagcaatgtatcttgtgcgtcatcccattagtttgggtcttaagctgtcactgggcatacttattgctggcattgcatgcatattcatcaactatgattgtgataggcaacggcaattattccgtaaaacaaatgggaactgcttgatctggggccgaccaccatcaaagatagaggcttggtatgaaaccatgagtggggagaagaagtcgagccttcttttgacgtctggctggtggagtgtgtcacgacattttcactatgtgcccgaaattcttgcggcatttttctggactttgccaggacttttcaatcatttccttccttatttctatgtcatctttttgacaatcctcctatttgatcgagctcaaagagatgaccaaagatgccgagcaaagtatggcaaatactgggatatatactgcaagcaagttaaatacaatattattccaggaatttattgagcaattggatagtttagttatgctatgactggatttctcggtcattacttaatgcagcctgtagcttagtggtaaggctggtgaccaccggcgttcgtatggcttaattgagcatgtgaaaatatcggaatcggaaaagcagaatacatgtagcaacatatattttcgaaagctcatcgagcagctatagaaacattaatgcatgaaagagatctaaatatttaaaaaaaaaa

SEQ ID NO: 149 - DNA, 2225 bp, Pinus radiata
aagatcagttctggtagtagctccaacaatgaagttcccagctccggctaggaatttgttgatagtgttgatagtgtttctggagagaatccttaccaggtgtatggtgagtgatagctcaaatcatgaacctccaagctcatgtactgcaacaaggatctcaccagctagctctggtattatcagtaacacaaagccagctgattgcagctcgttagcttctttggatttgcatgggtctatctccttgcctggaacagcaattacaaccgaggattttggaggaatctaccaccacaagccacttgccattgtgcatcctgcgtctgtggaggacattgtgaaagtagttacaatggtgaatgcttctcctaatctcacacttgcagccatgggaaatgggcattccataaatggtcaggcccaggccttgaatgggttggttttagacatgaggtctctcaaaggaattgagattttccaaggaagcccaacggagggtccctatgtcgatgcctgcggagacgagctgtggattgatgtcctcaaggctactcttcgcgtgggccttgctcctcgttcgtggactgattatctgcctctttctgtgggtgggacactctctaatggcggggttagtggccagacttttaagtttggcccacaaatctccaatgtgttgaatctgcatgttgtttcaggtaagggagaatccatgacttgttatcccgagacgaatcaagatctcttctatggagctctaggaggattggggcaatttggtattatcaccaaagccagaataatgctgcagagagctcctcacatggtgaggtggataagagctgtatacgcagatttcgaggaattcagagccgaccaagagctgctgatatctttaccagaggagggaacttttgactatgtagaaggattcgttttgacaaacaacgatgacccaatcaatggctggccctcagtactactctcgccctcaaattcttcctttgacttcaagctcataccccagactgcaggcccaatgctgtattgcctcgaggttgccttgcattatgaccacgacgaagatttcgtcactctcaataagagaatcgagagcatgctagccccactcagattcatcaagggattgcatttcagctttgacttgccctactttgatttcctgaaccgggtccacgctgcggaagtggcagccagatcgagtggaatatgggatgccccccacccgtggctgaatctcttcgtccccaagtccaaaatctcagcgtttgatgctaaagtgtttagagagattctgaaagatggtgtgggaggacccatcctggtatatccagtcactagaaacaaatgggactctcgcatgtctgcaattattccagaggaggacactttctacttagtggctctactccgttttagtccaccgtatccaagtggaccgccaattcagagcattctagcacagaatgaacagattctccattactgtacaactgcaggcattgacatgaaattatatcttccccattataaaacagaatctgattggaaaagacactttggcaggaaatggcaacagttcctgcaaagaaaaagcaagtatgatccaaaggctatcctcgctccaggacagaggattttttccaggtccactgattcaacagcattcacacgcttatactcatcatcgtgaagaccacttttgcccaccaatatattcccaaagattcaatcaagatttcattaccctttgtacagtcctgaaccccatctttttagctttacacaaaccatccattattcggtccttgactttctttttcttgggtctgcgattcagaccttttctcgtatggatggatgctacattcaaacgggcatattccacatgacattctcttgcatggagttatcttgttgactatgctgcaactgttttaaggtgggatgatgctgtaacatccatcacagatttccaaggaaggttattttgcaggcaaactgaattttggcagctgctggaagatgcagtcgtgaatgatgggagggatcaatgcaaattagtaccattcgacagctgccacctgcccattgtttgattccacgtggcacagaagcaaccacatactagaaaattggacatcttttttggtttattgtaattacaaccaggttcatggttgttggctgcaaaaaaaaaa

SEQ ID NO: 150 - DNA, 1711 bp, Pinus radiata
ggaagtaaagagcctcgggtaaaagcctcacaccatgtcaccttaaaacgctgacaattggaaagcgtcactattaactattcagcgctataatcagctcaatgacgtggcaatgacacgtaaatttcaatgacgtggttagtcaccattcgggtaacatcgaagcaacagtactccgtgggttctctcaatcaaagacatcattctcaagcaatctcgaaatccctgcatccatacctaaaaccgtcgcataacatatattgtccccgtaatttgtcacagtggatatccggataatttgtctccgagtgtcgattgatttacagcaatatgatgattttaagtctggaattcggcgtcagtggttatgatcaggaacgggtgagaaaacagcccggaattctcaggcgttagggcaaaaaaatggcgggggaattgacccaagcggagaaagaaacccttgctgccgttaatgtcggggcatcggcattatcgtttgcaggatcggctttcatcgtgctctgttatgtgcttttcagagagcttcgcaagttttcgttcaagctgatattctacttagcattatctgacatgttttgcagccttttcaatatacttggggatccaggaaagggattcttctgctatgcacaaggctatacaacacatttcgtttgtgttgcatcttttctttggacaactactatagctttcactctccatcgtactgttgtgagacataaaactgatgttgaagagctcggagccatatttcatttgtatgtatggggaacttcacttgtcatgacaattataccttcgattggtgatggctatgggcaagcgggtgcttggtgcttggttaaaacaacatcaagggctacaaaggtcctccaatttattactttctatgctcctctatggggagcaattctattcaacggtttcacatactttcaagttagtcgcatgcttaacaatgccactcagatggcagcaggcatgtcagatcggcaacaacaaaccgattcaagggttgatatgaaggcaatgaaccgatggggctattacccattgatattgataggttcttggacatttgccactgtcaatcgtatacatgattttattgaaccacaagaaaaggttttttggctttcttttcttgatgttggaacagcagccttgatgggcttgtttaattcaattgcatatgggctaaatgcttcagtacgacgcactcttcaacagaaaattgatttgtggtggccagaatggtttagaaagtggctacctggatttataatgctgagggatcaggcacatgaaagtgaaatgatctcacttaaaattccagttgaacagtgatatcgtgtattgtgtctagcttttacagtattaggtctcaacttattttcaagaaattacaaatcaatccttttgggaattcgctaaggttcagcaggtgcatcaagatcagatgattctaattcatccttcacttgttgaatttcatccatttgtttccagtcccctacgctgacctgaatgtaaatggaagcctctctatatattttagagtgtagactttcatctctgcagtgtccaagtgttacagcttattattttgaagtgagtaacacctagacatgacattgtacaacttaaagaacaatagaaatttgctctataattgaaggcaaaaaaaaaa

SEQ ID NO: 151 - DNA, 1485 bp, Pinus radiata
cgcacgaggattttgtgtgactttatttctgaactctgtgaggagtcactattttcaatgtaaagaggtggagtccaaaatccatttttaaatttttcccataataatagtttagccagatatcatctgtcggatgtatttttccaaaagcaagaaactgaaccactaaatgatttttttttttcatgaaacgctgctatgaaaatggtttcagtgatcctttttaatttatacttggcttggtaatgtattcagggtttccccattatattttgtgtttgttggaggtttttccggttaaaacaacatttaaaaaaaaaaactgcacactaatttaatgaaacccgatactttttggttctggagacgttcataatgcactgtatgctttacaatacacagccattcatacccagggatctctttatattgattcacactcttatacctccatgccctcttacccatatggtaggttgttgggaataaaaacttaacggtcccattctggcctctcactatcatacccagtgaaaaatatatatcagagagggcacccaatagatagattgagaggatcatggcatacaaagcagatgatgactatgactacctgttcaaagtggtgttgataggagattcaggtgttggcaagtcaaatctgctgtcccgatttaccaggaacgagttcagcttggagtccaagtcgactattggtgtggaatttgcaactcgcagcatcattgtggatgggaaaacgatcaaagcccagatatgggacactgcaggccaagagaggtacagagccatcacaagtgcatactatcggggggctgtgggtgctttattggtgtatgatataactcggcacactacttttgaaagtgtggagagatggctgaaggagcttcaggaccatacagataacaacattgttgtaatgctcgtgggtaataaagctgacctacgccatttgagggctgtttccactgaagatagccaagccttagctgagagagaatctctctatttcatggagacatcggctttggaatcgacaaatgttgagaatgctttcacgcaggttctcactcaaatctatagaattgttgtcaagaaggctcttgatgttagtgaggagccttctgcccttccgccacaaggacaagcaataaatatcaaggatgatgttacagctaccaagaagccaatgtgctgtaatttctagcaggcagaggcaagttgttagatgatgcggatatttgagcagattctttacagttgtagttgtttgcacgaattgttgagtaacttctttactcatttgagggtttctcagttctgatgacatatttggagtcacatgaatgctctattggctgagttgacaaaattaatttcatcgggtgtctagaatagaatcaaggaacataaatttgtaacttatgatgagtgatttcagcgataaaaaaaaaaaaaaaaaaa

SEQ ID NO: 152 - DNA, 3217 bp, Pinus radiata
caaatttcaagaaaaggttactgttttcgcttcccaggacggacgggcggtcggtctgcaacacgctttagagtttcaactgagatgctttcacacccttaatccatgaattgcttcactcttcttcccttcattccgccattcgtagaggtgcctcgttatatcttgacgtttttcatttcaggttttatgagctcaagaaagggaagaaacccattcattttctcttgtaagcagcgggcgaaggcgggattggggtttttgtgttaaaggcatgccgggcaagggttttgttagggacacggtacttgactgctgccttgcaacacctcgcatgcgatgactcagggaattagagcttcttggtattgcacttgggcagagcaaggagcattcgactacctttgctgaaacaacttcgttgtgagacaagctttgcagtgattgtattctatctgattttggacatgctatggcctcttgatgcactgcattgaatgttgtttcatgggacattgggtttttacacattctcgtgtaggaatgcggaagcaagagtaactgattactaaaatctcatcaagatggagtcatgtaactgcatagatccgccatggtcagcagatgatctgctaacaaaatatcaatacatatcggacttctttattgcacttgcatatttttctattccacttgaactcatctattttgtgaaaaagtcagcagtttttccttacagatgggtgttagttcaatttggtgcatttattgtgctttgtggagcaacacacatgataaacctctggacttttcatgtgcacacaaaagcagttgcaatggttatgactatatctaaaatattgactgccgttgtatcctgtgcaacggctctcatgcttgtacatatcataccagatttgttgagtgtaaagacccgagaactgtttttgaaaaataaggcagcagagcttgatagggaaatgggtataatacggacacaggaagaaactggaaggcatgtgaggatgctgactcatgaaatcagaagtaccttggacaggcatacaattttgaacaccacccttgttgaactggggagaactttagctttggaggaatgtgctttgtggatgccgactcgaactggtttggagcttcagctatcccacactcttcgacagcaaaatcctatgacttttaccgtacccattcaacatcctagcatcaaccaagtattcagtacaaatcgagcagtgatgatttctccaaatagtccagtagcaatgattcgaccacggacaggcaagtacatgattggagatgtggttgcagttcgtgtgccccttctgcatctctcaaacttccagattaatgattggccagaaccctcaaagagatggtatgcacttatggtccttatgctgccctctgatagtgctcgcagatggcatgttcatgagttggagcttgtggaggttgttgcagatcaggtagcggtggctctctcacatgcggcaattttggaagaatcaatgagagcacgagacctgctcatggagcaaaatgttgcacttgagatagctcgacaggaggcagaaacagctattcgcgctcgcaatgatttcttagcagttatgaaccatgagatgcgtactccgatgcatgcaattattgctttgtcatcgcttcttcaggagacagagttgactcctgaacaacgatccatggttgagaccatcttaaggagtagtaatctccttgcaacactcatcaatgatgttttagatctttcaaagctcgaggacgggagcttggagctaaacattcggatatttaatctccgcagtatgtttcgtgaggttcacaatttggtaaagccaattgcatctgtgaagaagttgtgtgtatcaatgaatctcgcttcagacctgccagaatacgctgccggtgatgataaacgtcttatgcaaactgttttaaatgtgttagggaatgctgtgaagttttctaaagaaggtagtgtttcagtgacggttttattagagaggccagaatgcttgcgagatccacgtgccgaattttacccagtgcagggtgatcgccatttctatttgagagtgcaggtaaaggacactggtgctggaatcaatcctccggatattccaaagctttttagcaaatttgtgcactctgacacaatgacaaccaggaattatggtggcactggtcttggactagctatttgtaagaggtttgtgaaccttatggagggtcatatttggcttgagagcgagggattaggaaagggctcaacttgcatatttattgttaagcttgggattccagatcctatacatgaaatggagcatcagtatgtgtttcccattccatcaaattctacccgtaaagattttcctgggctgaaagttctggtgacagatgataatggggtgaaccggatggttacaaggagccttcttgctcgtttagggtgtgatgtgacagtggtggattctggtcatgagtgcttgcaagcaatgtcacaggctgggcagaatttcaaggtattatttcttgacgtatgcatgccgggtatggatggttatgaagtggccattcacattcaggagatgtttcctaatcggcatgaaagaccattacttgtggctcttaccggaagtgctgacaaagcaaccaaggaaaagtgcataaagattggaatggatggcgtgttattgaaaccagtgtctcttgaaaaaatgcgtagtgtactagttgatctcttggaacacgggtcagtatgtgacagtatacagaggttatgaccgtgtctaaaaagtggaagttggtacacgtaatgctgtgccattgatcttatggatctgacaaacaatgcactgatttattcgtatgagaccaaaaaatctctgcaatcaatttaacacaacaaagttttgagatttactagatgccaaatttagtgatttgctagctcagtagtgagcatatttggtcttcttcgagttgatgtacacttcccagcatcctttacattggctagttgctgataactgtgggctattctgctttgtcagcagttacaagaactgttcaaccttctagcaaatctgttgccctaaaatattgcactgtctttgaagtgccacgcatgacatatggaactgtacagtatagtggctatatgcgacctgaatga

SEQ ID NO: 153 - DNA, 986 bp, Pinus radiata
cgaaatcttctccccgcctgtcaagtaacggacgtgggcgtccatgtaaagagcagaagaaatgatggcgattcggctttgatcagagaggtccctattgctcaaatttatcccgctgcgccgacccaattctttgaaaataaaaaatgtcgtttcgaaagcgcgccctgttcaaggttattgttctcggtgacagcggggttggaaaaacatctttggtgactcagtatgtacataagagatttagtagccagtacaaagcgactattggtgcggactttatgtcaaaggaacttcaggttgatgacagacttgtaacattgcagatatgggacactgctgggcaggagagattccagagcctgggtgttgctttctacagaggtgcggactgctgtgtacttgtgtatgatgtaaatgtgctcaagtcatttgacaacctggaaaattggcacaaggagtttctgaatcaggccagcccaacagaaccggacacttttccatttatgttgctgggcaacaaaattgatgtggatgggggaaacagtagagtggtttctgagctcaaagcaatgacatggtgtaaatcgaaaggtatcccctattttgaaacatcagctaaagatgattaccgcattgatgcagcattcttatccatagccagatctgcacttaagaatcaacctgaacaggaaatctattttttaggccttcctgaggctcttcctgaatcagagccgccatcacgcagcttttgtggatgctaatgtcagtgcaggagtattgtcttttacattgataaacaattttataggcatcttcttcttattcccaatgggaaatttttgggcattaacgggttggtagattgtgtctcagtgaataagaccaccaaaatcatgacagatgatccaaggtatctcgtcatgtccttaagagcttggtttctctttctatcccagtttttgttcttggccattcggttt

SEQ ID NO: 154 - DNA, 2475 bp, Pinus radiata
gcggtacatatatacacagatacaactagataccctctgaagatttttggggtaatctgcgatcattttcgtccgggaatttttttgtttgtttttaatttttgtgggctttgatgcatttgaaggtacgtaggacgttttagtttttccctgtagctccaaaatcggccatggggtctgaaatctaagcgctgtatgcatgaggcatatttgttattattaggattgcaattattattatggtggtgagaaggatgagctcgttccctgatgaactgctggagcacgtattggcattcctgtcgtcgcacagggacaggaacgcggtttccctggtctgcaagtcgtggtttcgaatcgaggcgggcagcaggcagcgggttttcatcggaaattgctacgcggtgagccccgctatactcatcaggaggttcccaaggataaagtccgttgcgctcaaggggaagccccattttgcggactttaacatggtgccccctggctggggcgctgatatccatccctggctggccgccatggcggaggcgtacccttggctggaagaactcaggcttaagcgcatggtgatcactgacgagagccttcagctcctcgcgcgttcttttcccaatttcaaggttctcgtgcttaccagttgcgacggcttcagcacggatgggctcgctgccattgctgcgcactgcaggcatattacagagctagatttgcaggagagtgacattgatgatcgtggtggcaattggctaagttgttttccggactcatgcacatcgcttgtttccttaaactttgcatgtctgactaaggaggtgaactttgaagcacttgagagattagtagcaagatgtacttctctgaggagtttgaaattgaatcgtttggtgccattagagctactacatcgccttttggttcgtgccccacatctggaggatttgggtacaggtgcattccttcacgagccacgcactgaacaatattccaagcttaaggttgccttacagaattgcaagcgacttcaaagcttatctggtttttgggaggttgcacctggttatcttcccttggttgagtccctctgttcaaatttgactagtctgaacttgagttatgcaacaattcaaagtgcagaacttaccaacctccttggtcactgccacaaactacagcgcttatgggtgttggattatattgaagataaagggcttgaagtggttgcctcaacctgcaaagatttgcaggaactgcgtgttttcccgttagacccttatggtcaaggagccgtgacagaggaaggccttgtgactatttcaaggggctgtcctaagttgacctctgtactatatttttgttgtcaaatgacaaatgcagctttgattactgttgcaagaaatagccctcttctcacctgtttccgcttatgtatatttgatcccacaagcccagatcatttgacaaagcaacccctggatgaagggtttggaacagttgttcagtcttgcaaaagtttacggcgtttatctatgtctggcttgcttacagacaaggtctttcaggtgattggtacttatggcaagtgtttggagatgctttctgttgcttttgctggtgatagtgattttgggatgcaatgtgtactatcaggctgtataaatctccgtaagcttgaggtaagggacagcccatttggtgatttagctcttttagcaggttcagaaaagtatgaatcaatgcgatccctttggatgtcatcctgctctgttaccgtgcatggttgcaaggaattggctgcaaaaatgcgtaacttgaatgttgaagttatccatgacagggatcagtttgaagatataagtaccatgactcaacccgtagatggactctatgtgtaccggtcagttgctggacatcggaaggatacaccacatttcatatacactatgtaagtggtcatgtcatttctcatgtaccatgaatgaagctggcatgttcttgctaaagcagcagagtaccaagcatggatgggattttcctctcatacaccatggattatgccagaaaattcttgtgatactgacactttcaccttccatcgcaaaatttgtatgccttgtacagacaaatttcagcattcaaatactgtttggcatagagttattactgtcatttcagcactatgcggcagtatcctctaatctaggactgttcgattgatcgttggactcccttaattatgctacagattatttaaatgcagcaaatgaacagcctggcagattcctagtctggaattaggcagtaaatagttatttaattatataggcatacagtgtgatttcgtttcattttttagagaacccttccggttaccgctatttaagactgccatgttcagaaaatcttatttgattgaagagaagacaacattctctgcactatttctttctaaaaaaaaaa

SEQ ID NO: 155 - DNA, 1258 bp, Pinus radiata
aaatcacataaaaacagggagattcgaaagacggttttcctgttgtcggcaccattggaaaattgagccagggttcgaacaagggtttgcaggtttctcatctctttaagagccgtttgatacaagacttcgccaatttaaacagcagatctctggagctttcaggcccggaattgtcccagcaactcgtgctctgcgtaatgaaaaatgaggaaccttctcctagatcaatgaggagagacgacgccaggccataatttggcaatacattcgacatagtttacagtatattaccagttccatcgattccagaatttatattttgacaaaatcaagaactaactcccaaaggcaattgcatggtttgattctgggatagtagttctccaactccatctggactgaacactaaatataaccacaaaagtcaaaagtcatggcacagcaatccttaatatacagttttgtggccaggggaaacattgtacttgcagagcatacatcattttcggggaattttagtattattgctgtccagtgcctgcaaaagctgccctcaaacagcaacaagttcacatacacatgtgataaccacacattcaattacctcgtggatgatggatttgtgtttcttgttgttgcagatgaagctgcaggaaggcaggtgccttttattttcttggagagagtaaaggaagattttaagcggcgttatggaggaagggctgagacaagcatggcgcacagccttgataaggactacgggccaatactgagagaccacatgcaatattgcatggaccatccagaggaactaagcaagttttttaaaataaaggctcaggtttcagaagtgaaaggaattatgatggacaatattgagaaggttctggaccgaggtgaaaagatcgaacttcttgtagataagacagaaggcttgcaatttcaggctgataatttccagcgccaaggaagacagcttcgacggaagatgtggctccaaaatttaaaattcaaattgattgtgttgggtatcgtactagttattatgcttataatatggttgtccatttgtaagggatttagttgccattgacatctaagtggttttatgtacatataagaaactggcatgtttatgagtggaacaactttttgtatatcatgaaggtgaataagaattaagaacacaacgagctaaatgaattgataggggaggaaatgctcatattgagtcacatttgatgtaaaaaaaaaa

SEQ ID NO: 156 - DNA, 1854 bp, Pinus radiata
gagattctgagtcaggttcaatactaaatcatttctgtacgagcgagttatgtgtggtttgcggaaaatgacagaagattagaaaacgaaagagcagatttcaatgactggacgacgaggaaaaggagataaacaacgtcacacaaaatgaaaatgtggaggggatggcattttactgggtgaggtctcccacaaggagaattgtagcagctcttcttctggggggcggaattgggtgttttgtgtggggtgctcacctctcctaccaaaacgtggctccccaacaggctcgcatacagaagcgcaacgagttcatccgaaaacgcctgcaggcgcgacgatcgggcaactagcctaacgaccgactaatgtttgattccaactagcctacggtgaatagaatcgtcgtaattatcgtcatcatcagcagcaatgtctattataagcatccccgaagtggaagttgaaatgggctcggcatcgcctaacgccaggactcttcgagccactgttgttcaggcctccactgtcttctacgacacccctgctactctcgataaagcagaaagattgatagcagaaggtgctgcttatgggtcacagttgcttgtgtttcctgaagcttttattggtggctatcctcgaggttctaattttggtgctgtaattggaaatcgcacttttaagggtcgggaggagtttcgtaaataccatgcttctgctattgatgtgccaggtccagaagtagagaggatatcagctgcagctgcaaaatataaagtgcatgtaataatgggtgtgatagagcgagcaggcttcacactgtattgcactgttcttttctttgattctcaaggaagattcctagggaagcaccgtaaactgatgccaacatctttggagcgtgtgatttggggttttggtgatggatctaccttacctgtgtatgacacatcaattgggcgtgtgggtgcactcatatgctgggaaaaccgaatgcctcttttgagaacagctttgtatggaaaaggagtggaactctattgtgcaccaactgctgatgcaagagagtcatggcaggcatcaatgcttcatatagctctggagggtggatgctttgtgctctcagctaatcagttctgcagaagaaaggactaccctcctccaccagactatgtctttggaggttcagaggagaatatgtctccagagagtgttgtatgtgcgggtggaagtgttattatttctcctactggtactgtattggcagggcccaattttgaaggggaggctctaattactgcagatcttgattttggtgaaatagtgcgagcaaaatttgattttgatgtggttgggcactatgcaagacctgaagtgttgaaattgacggtaaatgactatccattgaatcctgtcacattttcttcagggatagcagcatcagaaaaaaaggacagtgagaatgtgtaaatttaatctgcaagcatggccaaggcccagtacattcagatgctccctgaatggatttcagaattgtcttaatggccaactatgctaccatatggcatgatgaataggctcgagcatgagtagaaggaactatttgttattgaaaaacagttgtttaagtatccaaaatgtataactacagagaccatcttttctgtaaaacttatctttgtatataacaagattgagcatgcctagaatagaaagaacaatttgttattgagtaatcagggaaacatttgtataagtattcaaaatgtagaactacagacaccatagctttgtaatgatttatatttgcatatagcaaaatatagacattattttacggaaaaaaaaaaa

SEQ ID NO: 157 - DNA, 1099 bp, Pinus radiata
gcgctcccgtgggaaacaaatgctcagagatccccacactgccctacattgagccgttcagcagctaaaagtcccttacatttcactttaagctctacccatttcatttctgcgctttaacaagccccctgtgtgcgtttctagtagcaatggaggacgatcctggtgaagattacttgttcaaggtggtgttgataggggattctgcagtggggaagtcgaatctgctgtcgaggtatgccaggaatgagtttcacatgaattccaaggccacaataggtgtggaattccagactcagagtatggagtttgatgggaaggagatcaaggcacaaatatgggacactgcaggccaggaaaggttccgggctgtcacttctgcttactataggggagctgttggtgccctcgttgtttatgatatcagcaggaggcacacatttgagagtgtgggtcgttggcttgatgagctcaaaatgcattccgacatgaatgttgttacaatgttggttggcaacaaatgtgatttggagtctctgagagaggtaccagttgaagaaagcaaagcccttgctgaagcagagaagctgtttttcatagaaacttcagcattaaatgcgacaaatgtgaatgatgcctttcagattgtaatcaaggaggtttacaataacatgagtcgtaaagccttaaactcaggttcttacaaatctaaattgctatcaaacggaagcactagtgtcaaccttgtgcagaatggggatgctgcaacaaagacagggttaaaaaagtatggttgctgctgaaatcaaatctcttttttcctcatgggttccaaatttactttatttaatcaaatctgcagtgttaaccacctgttatctacatgggattcttacaagctattcttcattttcagttgtaataaaaatggaagcatcttggatgtattgtgttgacagtcaagcttgtagggtcctctgtttttgatctgcatgtggagaggaatcggaagttttgtttgtctatttgtggaggatctatgacatttgctggatcctaatgctccatgtattcatcagtgtttttatagaagtaatgt

SEQ ID NO: 158 - DNA, 1122 bp, Pinus radiata
gatctgcactcctctgtgattgcttcttttaagtgttttttgggtttgaatttgcctttatacaaagatggcagtgcccgttattgacataaagaagctgctggatggagaagaaagggagatgaccatggaccagatacacaaagcctgccaagaatggggtttctttcagcttgttaaccacggcataccgtacagtcttcttgatagagtgaaggtattgttcaaagagcattacaagaattctatggacgcgcagtttcaggattctgcagttgtgcaaatgcttgaaagttctaactcccaaggcatgaatctcagtgccactaaaatagacgccgactgggaaacgggcttcttcctcccactctcgtcgcataaaacagaaacagtgacaccgcctctgcctgccaacttcagggagacgatggaggagtttgcagaggaggtgaagggattggcggaaagattattagaaataatgtgcgaaaatctgggactggagaaagtatatctgaaggaagccctggcaggtggcaatggtgataacaatagccctttctttggcataaaaatgtctcactatccaccatgcccaaggccagaccttattgacggcctccgaaaccacacggacgccggtggacttattctgttgctacaagatgatgaaatcgacggccttcaagttctgatggacggcacttggttcgacgtacaacccattcaacatgcaattgttatcgacataggcgatcagctggaggtgatgacgaatgggaaatataagagcatgtggcatcgtgtgcttgctaaagaggacgcaacaagaatgtcagtagcagcgttttataacccttcgagtgatgcagaggtgtatcctgcttcgcagctgatgtcagcagagcagaatggaagtaacaatgttaatgcagaaagtggttatgattatccaaagttcgtatccgcagattacatgacagtgtatgctgcgcagaagttcctgcccaaagaaccgcgatttgaggcgatgagatcagtaggtcatgccgtgaattgagcagcaatccacatggaatttataaggataataaaatcaaactaaagtaattaaaaaaaaaa

SEQ ID NO: 159 - DNA, 1370 bp, Pinus radiata
gttctacttagccctgtggcttctgcctacaggatcaagtatccatctttgttctcttctgctttgggtatatttgttgagtatccatcttgtcagtttgtaatttggtttttaatattttttgactggagggattagggatggccaccaaggtggatcctccgaatggggttgctgcagaggggaagcactactattccatgtggcgcaacacgtttgagatagacaccaagtatattcccatcaagcccattgggaagggtgcatacgggattgtgtgctcggctaaaaacacagagaccaacgagaaagtggctattaagaagatcggcaacgtattcgagaaccggatcgatgccatgaggacacttcgggaaatcaagcttctcaggcagctcgctcatgataacataattaccttgaaggacatcatgacccctgttggcaggtctaatttcagggatgtttatctggtttatgatctcatggatactgaccttcaccagatcatcaagtcttctcaggccctcactgatgatcactaccagtacttcatctaccagttgctgcgaggcctaaaatatttgcattctgccaacgtgttgcatagagatttgaagccaagtaatctattattgactgccaattgtgaccttaagatatgtgattttggtttagctcgaacaaactgtgagacagggcagttcatgactgaatatgttgtcactcgatggtatagggctcctgaattgcttctgtcctgtgatgagtatggtccatctattgatgtgtggtctgtaggctgtattttggcagagttgttgggccgacagccaatattccctggtaaggattatatcaatcaacttaaactgatcatcaatgttattggcagcccagcggaagatgatctttactttgtccagagccagaaggcctgcagctacatcaaatcacttcctcatgttccctctgcttctctgcaacgtttatatcctcaggcaaatcctactgccatcgacctactagataagatgctagtttttgatccttacaagaggatcactgttacagaggctcttgagcatccatacttctctgcgttacatgatccaaggctcgagccttctgcaacagcaccttttgaattggacatgcctgatgaggaattgagagtacaggaattgagggagatggtctggaaagaaatgctatattatcatccagaagctgcaaatatattatagatacacaaaattatccatttgttttttgttggataacttcatggatgagaagatgagatgtagagatggataaagtttgaatatatctcaaagcacggccttgagttttgttcaaaaaaaaaa

SEQ ID NO: 160 - DNA, 1804 bp, Pinus radiata
gaaaagacattcccgtgtattgaattgggaagcaatgggaatcgaactagagatggacagaccccaggaagagggctgggtgaggggtgccattcttggggccggagcttacggaacagtcagccttggcgtgagcaggtccaatggccaactctttgcaatcaaatctgcagccggctttagtgtcgctttggaaaatgagtaccagattttgcggtgcctcgattgtccatacatcgttcgctgcctggggcacaattacagcttcgaaaacggtgcagaggtgcacaatttattcttagagtacatgccaggtggcagcttggtggatctactgggaaggtttggagggacgctgaacgaaacagtgatcagagcatacacacgcggcatcctgcgtggactcgattacctacacagtcaggggattgtgcactgtgatatcaaggggaagaacattcttgtggattccaatggtgtgaagcttgctgactttggttctgctaagagggttgatgatgaggagaagtgcgaggaggccatgcaattgaggggaacccctcagtggatggctccagaggtggtgaatcaggtggagcaggggcctgcttctgatatttggtctctcgcctgcactgtgcttgaaatggccactggcaggcctccatggagccacgtttccagtccccttgccgcaatgtatcgaattggatgcacagaggagctgcctgggttgcctggatgtctttcacctcagattcgggatttcctagagaaatgctttcggagagatcctaagaagaggtggagcagtgcagagctgttgaaccatcctttcttaaaaaaggactgctctgttattgaggcagaggaggccattaggggtccgggatctcccactagtcatttggattttaggaatcacatatgggattcctactgttctcagacgactctcattccgtcactcagtctcccaagcccaactagggaacgcaatgcagaggtgaatagatcagttgagcaatgcccaaggcgttctcccagagacagattgatggcactggccgcagcttgtaaatttgaaaaagttgcgaacaggcctaattggatcacaagcctccatggtccatggactgttgtgaaatcttccagaagtaaatctccaacttcagataagcctctgttaaaatcagacattagtaatggctcctccatccaggagcttccatttacggaagaaaggtgcagtaccagcttcaaagctgtcaattggaaagggttgcagccaagaggtgaactagatcaatgctcacaggctatgctctcttcagcccaatctcaacatcaaccatcttccagcacttcttccaagactccgcatcataacttgttttcgctggctgagacatccaatttgactggtgaagcttgggaatcggatggaaattcatctcagaggattgttggtggtgattagtagttgaagaaacgctttatatgtttgatgataagcgtaagtctacgacttgtgcaggagcaacttactgcccctgtcgctgtatgcgaactccacaattttgtcatacaagtatcagaaatctgtagttgtatagtagccgcagagcagatacatgctcttgtaattttgattcaaaattaataccggttgagtttgttcggttacactagccgcagagcagatacatgctcttgtaattttgattcaaaattaataccggttgagtttgttcggttacacaatatatgacttcatgattagccatttaacttaaaaaaaaaa

SEQ ID NO: 161 - DNA, 1258 bp, Pinus radiata
gtcgctgctcctcccgctacggaaatttcttccctatttgaacccctttcgagccactggttttccaaggaccatactgcgccttctgctgcttcgcttcttgtgattttgcatttcagactctaatcaagtttgtatccattgaacaacaacaaaaaatgtcgggtcgcagaaatccgctgttgaatatcccaattcctgctcggcaacagactcagctgtatcgacttcctctgcctccgcagagcacatctgtgtccagagacgtttcggatcttgcagacttggagcgaattcagattctcggccatggaagcgagggcaatgtgtacaaggtccgacacaggaggacttcggaactttatgccctgaaggtcatccatggcaatcacgacgagactgtgaggcagcagataatccgacaaatggagattctgaagaaaacagagtccccgtatgtggtgaaatgtcacgggattttcgaaaggggggaagagatccacttcgtgctggagtacatggacggagggtcgctggaacagaggagatccgacaccatgtcggaaagatttctggcagaggtagcaaggcaggtcttggagggtttgaaatatctgcaccgtcacaagatcgtgcacagagacataaagccctcaaatctgctcataaacaggagacaagaagtgaaaattgcagactttggggttagcagaattctgtctcagacattggatccctgtaatacttatgtgggtacctgtgcctacatgagccccgagagattcgaccccgagacctacggcggacggtacgatggatacgcgggcgatatatggagcttggggttgagtctgctggagtgctatactgggcatttcccgtttctggcagcagggcagaaggcggactggccggccctgatgtgcgcaatctgttacggggatcccccggctcctcctcccacggcatctgcccatttccggagcttcatcacatgctgcctgcacaaagatgcccgcaacagatggaccgctgctcagctcttggggcacccttttgtgctgtcaaatcccccccagacaccctccattcctatgcagaggctctccatctgatccaatgttccccatgcgcaaattactctgaacacatgagatgaaataaaactgcatgtgtatgaatctatgatctgtctaataacttgggtaaattttgttcaaatacctggttttggttttcgttttgtttaaaaaaaaaa

SEQ ID NO: 162 - DNA, 1817 bp, Pinus radiata
cattcatccatcatgcattctgcctatccatcttccccgaaaccgttgcatccctgcctcttcatttcatagtctccttccatgcacatcttaactaacacatacacattgtatatacatcttttccgtagtacccacttctctgccctgctgctgctgctactgcaacatcctcccgtgcacagcccttatacgacacacacacatcgagtaaccagaccctcggctcccgttttaggcatatgcacgtcgagtatcgatccatctgctcagtctgcagtttgaaattttcgattatttgtttctgattcggaaggatggccaccagggtgaatccgcctaacggagtgtttgtggaggggaaacactactattcgatgtggcgcaacatattcgagttagacgccaagtatattcccatcaaacctattgggaagggcgcctatggaattgtttgctcggccagaaacgcagagaccaacgagaaaattgccattaagaagatcatcaatgcattcgagaaccagaccgatgcgaggaggacgctcagggaaatcaagcttctcaggctgttcgcccatgataatataattgccttgaaggatatcatgacccctgttactagaactaatttcaatgatgtttatctggtctatgatcttatggacactgacctacaccagatcatcaagtcttctcaggtcctcactgatgatcattgccagtacttcatctatcagttgctgcgaggactaaagtatctgcattctgccaatgtgttgcatagagatttgaagccaagtaatctattattgaatgccaattgtgaccttaagatatgtgattttggcttagctcgaacaaactgtgagaaaggacagttcatgactgaatatgttgtcacacgatggtacagggctcctgaattgcttctgtcctgtgaggaatatggtacatctattgatatttggtctgtaggctgtatatttgcagagttattgggacgaaagcccatattccctggtaaggattatatcaaccaacttaaactgattgtcaatgtacttggcagcccagatgaagatgatctagaatttatcgagagccagaaggcccgctcctacataaaatcacttcctgttacttcccatgcttctgtacaacgtttataccctcgagcaaatccttctgccatcagcctactagacaagatgctagcttttgatcctcgcaaaagaatcactgttacagaagctcttgagcacccttacttttctgcacttcatgatccaagcctagagcgttctgcaacagctccctttgatttggacatgccggaggaagaactgaaagaggaagaattgaaggagatgttctggaacgaaatgctacattatcatccggaagctgcaaatacatcatagataggtgtaaaaatgtctattgtcttgtgttggatgacttcatggaggagaagatgagacagaaagatggcctggctgatgggacagaaagatggcctggctttgaattatatcttgaagtgtggcgagaagttttgttcaatattgtacatgtatacaatttcaatttgtgctttctctctggaatttttctgagaattgcggacttttattttcaatgctctgaaagtatgaagagagagcgagtcttttataacaggttattttattgtaagaaagcacacttgtttatgtgtaatttattcatcatattcccattgtaaataagatggactgctagttgtctaaatcaataatatactctttgataaaaaaaaaaaaaaaaaaaaaaaa

SEQ ID NO: 163 - DNA, 3201 bp, Pinus radiata
gctccagaatccactagtcttttccacatgcacggtccagtcctcagtgttcacccataaggacaccccatgtttgttaatgtatccagcagactatctgccttatcttgccttgccgagcctgctgtaaagccactatcccagaccatgaccatgttttctttattgttttcttgtctgctagctcgcccataagacctgcctgtccccttccgagcactgcatgttttttgtctcatcccctgtatcatgaaccacaatcttttagaatatacaactctcgctctgctctttctcagcgcctgcaacacccaccttgatttctgcaatctcctctgctgcatttcttcttatcttctgaacttcattgaaggcctactacacttctacatatgaatggcttcatgtctttgctcccctctctcaactgcatgaactgttgttattcttgggaggattgaggagatctaggttcttcttgaccatactactcagctttgttgaaatgtactcgagaacttcataatggactccaccatgcccggtcttgtccccacccgtcgagtaggtactgcttattgagtatgctatcagattcggccccagaatctcatctccacgctttccaaggcttcagaaagctataactgatgtgggtgtggtgaaatctcatccccatacttttaaaggccgttcacagagctcgggactgatgtgggtgtggcgaaatctcatttccatacttttaaaaggcctgtcacagagcttgggactgatgtgggtctggtgaaatctcgttttcataccatcactgagctggaaactgacacggttatggtgatagaagccatccatggtgctaaaagtcaatactaaggagacccaccagcgaaaacaatgctggtagttcttgcaaatggttgttggctttagcttttcagtcattcgatgactacagacgatgagaagggtgcccagatggcccaaatgagacaggaacattcagaaaaccctgaggaggaggaggagcgtgtgagctttgatctgaactccatgtgcaagttttcatcccagagtgacacagaacccattgaaacctccttccccgatgaagttctcgagcatgtgcttgtgtttctgacagcccacaaggacagaaatgcagtttctctggtctgcaaatcgtggtacagagtagaggcttggactcgacaccaggtctttatagggaactgttatgctctttcgcctgggactatgattaacaggttccccaagataaagtccgtgacattgaagggtaaacctagatttgcggatttcaatctggtgcctccgaactggggagcccatctgcatccatgggttttggccatggctccggcctatccatggctggagaagctgttattgaagaggatgactgttacagacgaagatctggctctgcttgccgactctttcccaaactttaaggacttagtactgctttactgtgatggattcagcaccaagggccttggtataattgcaagcaagtgcagacaattaagacgacttgatctgaatgaagatgatattgtcgatagtggagttgattggttgagctgctttccagaaacaactaccactttagaatgccttagttttgaatgtttggagggcccgataaatattgatgcacttgaaagattggtggcacgttgcttgtctctaaaagaactaaggctgaataggactatctctatagtgcagctgcatcgacttatgttgagagccccacaacttacacatttaggaacaggctgtttctcctatgattttataccggagcaagcaacagttcttcaggttgccttcaacaattgcaagtcacttcagtgtttgtcaggatttcgggaagttgttcctgagtatctaccaacaatctattctgtttgcaataacttactggagctgaacttgagttatgctgttatgggtagcagggagttggagcagattgtctgcaattgtccaaaattgcagcgtctttgggttttagactcagtggaagatgcaggtctacgggctgctgctgcaacctgtaaggacttgagggatctccgagttttccccatggatgcaagagaggatgggaatggttgtgtatctgatgagggtctggttgccatttcagaaggatgtccaaatctccagtcgatactttacttttgtcagcgtatgacaaatgcagcagttgtgaccatgtcaaaaaactgtcagaaccttaccagctttcgactctgtatcatgggtcggcacaaacctgatcatattactcataaaccaatggatgaaggatttggtgccattgtaatgaactgcaaaaaactgacgaggttggcagtgtctggccttctgaccaataaagcatttgaatacattgggacatatggagaatcattagagaccttatcagtggcatttgctggggagaatgatttaggcatgaagtatgttcttgatggatgcagacgtctacggaagcttgaaataagggacagcccttttggagatactgcccttttgtctggtttacatcattatgagcaaatgcgatttttatggatgtctgattgcaaggtcagtatacagggttgcatggagctagcaagaaaaatgccctggctgaatgtggaaataatcagagaaaatagctacgatgaccgccttgtggaaaaactttatgtatatcgttctgtagcagggcctcgtaaagacatgccaccaatcgtaattactctgtagccatttcctgtccaattttgtggcaatggccattgtactatttgggtgaatctgtaagcgaccgtgctttcagttcttcatgtccagtggttgtaggggtcaagtccttgtacatatttcttttacaagtgcagtggagtaggaggtcaaattggcaatattctttggcatttccttcagggtgatgctgaaaggtggaggacgaccaatgaatgctctatgcacacgcattgggcactattttagggtccccaactgacatgattttaaattgaagttattgttaagtaatgactcttttaatgagtctttttgccatgtcacttcaataagcttttgaagtgaattctacatggataattttagttgtttttattaagaaggtttgacttacacttactaaaaaaaaaa

SEQ ID NO: 164 - DNA, 1156 bp, Pinus radiata
ccaaatagcaccatctgaaaatgctcggacacagtaaattaaattcactcgagaataagttcctcgccattcacaataaatgcgcagagcattgccatccatgctcttcatctacttccgtcctggctatcctatcatgccaaatttgcagataggttttagggtacctccaaatgggttcaagcagtcatcgggaaaatggagcagtgaaggcggtcagctgttccaaagaggataaattagagcaaagcagagtgaatttgatgagaagtattgttgaagctaaggactcatctgcaaaggctacagatgatgctactctcagacgttttctgcgtgcacgagatttgaatgtgggaaaagcttctgagcttttcttgaaatatctaaagtggaagcgagcatttgtgccccttggctatattccagagtcagaggtctccaatgaactcaggaagaataagatttttattcaaggactggacaaacaaaggcgccccattggagtgattctcgctgcaaggcataatgcctttgacagggatctagaggagttcaaacggctagttgtctatggttttgacaaaatatgtgcctgtatgccaagaggacaggaaaagttcgtcatgttagcagatctcgagggttgggggtataagaatgtagatatccgtgcctaccttatggtacttgaaattatgcaggattgttatccggagcggctgggaaagttatttatgattcacgtcccatacctattctgggcagcatggaagacggtttatccgttcattgacaaagtgaccaagaaaaagattgtttttgttgaagataaacaccttaaagaaacattattgaatgatattgatgaaagtcaacttccagaaatttttggagggaaattgcctttagtacctactcaagattgtgtcatacccaactaacactagataccttgagttaggaatgtggaaggttttaatagcaatggttaccaaaaagtagattagcttttctttagacatatattgcaaatcctattatctttccatttttttttacctttttcatatgtataaatattggttttgaaaacattgagaatggtcaatgttttgacatttataacaaatttattaataatttaaaaaaaaaa

SEQ ID NO: 165 - DNA, 1110 bp, Pinus radiata
caggggttgaaaattatctcggtaaaaattagggttttgtttgatgagagggcgcgagaggccagttgattagattgccccatcagattcccacgtccgactctctggccgatgacagagcttccatttaaataattctgctcattaccgtgtcgctattgaagtaagagaacccaaaggctctgacgatgctcttgattccctctgtggacgcgctttagatttgttcatttcttctaaaatggagaacgttggcggtgaggagtacctgttcaagatcgtggttatcggggactctgcggtgggtaaatcgaatttgctgtcaaggtatgctcgcaacgaattcaacgccaattccaaggcaacgataggcgtagaattccagacccaggtgatggatatcgatgggaaggaggtcaaggctcaaatctgggacacagcaggccaggagaggttccgggcggtcacatcggcatactacaggggagctgtgggagccctcattgtgtatgatatcagtcgcaggcttacttttgataatgtcgcccgctggctcgaagagctcaagatgcatgctgatggcaatgtcgtgaaaatgcttgtggggaataagtctgatttagctcatatcagggaagttcctgtggaagatgggaagaagcttgccgaatcagaggggctgttcttcattgagacctcggctctggataatacaaatgtattgcctgcattccaaattgtggtcaaggagatttacactaatgtgagcaagaaaatgctgaattcggattcctataagtctcaattgtctctcaacagagttaatattacggatgcatatggagatggagatggagtggatccacccaagacaaagaattcttgctgctgaggattcagagagaatgctcctttgtttctgggctccttgaatattatttgcttcatatgacctcttgttgattgagatccttaaggctgccttatgctaatttaatttttttttgtttattaggaaagtttcaatatgttggataattttttttcaattttatgaagaaaccagtaagggtccccaactgggcttcttaggcttgagccctagatgct

SEQ ID NO: 166 - DNA, 2590 bp, Pinus radiata
gattggaattcatgagacgaaaattacggtacagatgaatggctggaaataatgaatcccaataaaatgagaccttgagattcacccaagagagtatggcctttcctggtctggttttggtaaagggcagagtcgtataaagaaggcggaagggaggagggcagagtcgtataaagaaggcggaaggaaggagggcaagtgagaattccctagcaaaatcgcgtggacaaatggtcaattcgtatatgtggaatgcacccagccaggaatttcgttgcgggcagagggcaaagacaagggttatggcttttttcgaaattcattcggttcaaatttgacctgaatacggtttctaacaggttagaatatacgattctagacgcttttacttggtcgctgcacgcagtcctaattgttgttttcctgttcttgtggttttccaacatttttaggatcatataccggagtacccttacatgaattttagctccagaggttcggatttgggttgatgccgcgaggcttgtgatctgtgatacattgtcgtcgtttgacccaagaatcgacccaaatccattctttatatgtaatatgcaggaaaggtccgaggagtaaggattcccagcctagaacccaaaaaataaggtccaaggtcgaagtcagaggcttgtgctacatcccagtgttttttgggattctgtcgagtcctcaagagggctttttgctttacggagtacccatctggaattagtgagttcagttgcctgcctaagagttcccgcatagggcaaggatttgtttgagattgaaaaaggagggcttttgcaatggggcatgcggcatctgtggtcattcccccacaagaaacaaaacaagaggatgaggattcccaagaaggcgtagactacaccctgaacattcctgatgaatgtctggcacacgttttccattacctgaagcctggtgataggaagccctgctctttggtgtgtaagaggtggcatcacgcggaagggcagagtcggcgtcggctgtctcttgatgcacgggcggagattgtgccggccattcctagtttgttttggcgctttaattatgtttccaggctcgcactccgaggcaatcggaggacgattggtatcaacgatgacggactgcttctgatcggcattcattgcaagaacttgaaaaatctcaaattgagatcctgcagagagataacggacattggaatgagtaggttcgcacagttgtgtggttccttgaggaagttttcttgtgggtcatgtacatttggtactccggggatcaatgctatcacgacccattgcaaatctttggaagagctcactgtaaaacggttgcgaagcgcaggggaggtcccttctgaaccagttggacctggagcggggaatctgaagaggatttgtttgaaggaattatactacggacagttctttgtcccactgattgcagggtcaaaaaaattacaaactcttaagctttctaaatgttctggggactgggatactcttttggatatcatcactcaggatgtcacaagccttgttgaggttcttttggaaagattgcatgtgagcgacacgggtttgctagcagtttcaaaattggcaagcctggaaattttgcatttggctaagacgccagaatgctctaatactgggcttgcagctattgcaaatggttgtagaaaactgcgaaaattgcatgtagacggatggagaacaaataggattggtgatgagggtcttattgagatagctagaaagtgtcattatctgaaggagttagtattgattggagtcaatcccactataacaagcttaagtatgttggcttccaattgccatgtattggagagattggctctctgtggcagtgcgactattggtgatgcggagctttcttgtatagcagccaagtgttattcactaaagaagctgtgcattaagggctgcccagtctctgatcaaggcatggaatctttaataagtggatgccccatgctcgtgaaggtgaaagtaaagagatgcagaggtgtaaccagtgagggtgcggacttgttgagagctaataaaggttccctggatgtaagtttggatactataacctcacctagtctgaatgggttatcaactcaagccagctcgagtgtgccaagagcatctgccatttcttcagctggtaaatcaactctatctaaggcaagattgacccttatagcaggtggaagctttcttgcctgtgcctttttaaagttgtcaaatggctcataagtgaacctctaaggctcattatgcggaggtctaattgaccagtattgttgaataaagaatactgcatttgctgtttatcttatcaaaccatttactgatggatatctgaggtattgatgttgtacgatcctcagatctacctttgatgcgttatgctgattattcatttggtacattctgagattgcgcatgggtttctgaattggcagaagcaaactgggttgaatcaatacagctaattttctttttttgaaattaatgttttttgggattggatttgaccaaaaaaaaaa

SEQ ID NO: 167 - DNA, 1848 bp, Pinus radiata
tggctatgcagcgctccagcggagcctgctttgatgcagccattccttcaacagctctgttctttggttgttcagaaattccttgatgaagtctgctccgttccaacctcatggtttggcagtggtccaaattatttacaggttgttgggttcggttttagcccgacttacttggtgggggcgacgcatctacagcgacggacttcaccggttacggtcttgaaggattcaagaaattcgagttgcatgaaagaatggccggcttagataatggggtagttaatggtatcgtgtctgtgaaattcaccaaactctttattgatggaaaatttgtggacgcaatttcagggaagacttttgaaactttggatcctcgaacaggagatttgataacgcgcgtcgcagaaggtgataaggaggatgtggatttggctgtgaagacggcccgggaggctttcgataagggaccttggcctcgaatgtctggctatgaaaggggtcgcttactgaataggtacgctgatttggtagagcagtatatagatgaactagcagctcttgaaacactagataatggacaaccactcacccttgtccgtgtcattgtgacggggtgtatccagattctcagatactatgcaggagcggctgataaaatacatggggaaacattaaaaatgggagggcaatatcaggcatatactttgcatgagcctattggagtggtcggtcagattataccatggaacttcccacttttcatgtttttcatgaaaatctctccagctttggcttgtggatgcactatagttatcaaacctgcagaacaaactcctctaactgcactttattgtgcacatctggccaaggaggcagggcttccacctggtgttcttaatgtgataactggttttggagaaacggctggtgctgcaataagcaaccatatggatattgacaaggtagcctttacagggtctactgatataggtcgggttatcatggtggccgctgcccacagcaacttgaaacctgtaacccttgaactcgggggaaaatctccgttgattatcatggatgacgctgatattgaggaggccgtgaatcttgcccacaaggccatattttttggcagtggacaagtatgctgcgcaggatcccggatatatgttcaagagggcatccatgataaatttgtgaagagagtagtggaaagagcgaagaaacaggtggtcggcgatcctttcaacccagaagttgaccatggtcctcagattgacaagacacaatttgaaaaaatattagaatacattgagcatgggaagcgagaaggagcaaaactattgacaggcggtagtcgcgtgggtgaaaaaggattttacattgaaccaaccattttctcccatgtgcaggaggacatgaagattgggaaagaagaaatatttggaccagtcgtgtccattttcaagttcaggaccattgaagaagccatagaactgggcaataaaacaatatatggtttagctgctggaattgtgtcgaagaatatagatacagtcaataggctttcgagatctattcgagcaggagtgatttgggttaactgctaccacgtagtatttcctgatgctccgtttggagggtacaagatgagtgggatcggtagagagcagggtctcgatgttcttaaaaattatttggcagtcaagtgtgtcataactcctctccatgattcaccttggttgtagaactatgctttaacctctttcaaatgtgtttgtcaaatgctttcatagctttatatatttaggttgaagcttcaataaatctttgtatgtaaaaaaaaaa

SEQ ID NO: 168 - DNA, 1703 bp, Pinus radiata
caatttcgtcgcaagtcgatggagaccgacagtcctctggtcgcaatttcgtttcagccgccgccggttgcatttattgggcaagaatttgataattttttatttttgaaattggacgaatttccgtgcatttcatttcatttcaggtctgaacagtcagaccagcgagctctacaaaagcttcaggtactgtgagggaaagggcagctcggcgcaccaaagagcggcgaaataatggtgaggaatttgcattggtgcagagcaattgttactatcagctcggccgttcttttatgtacattttgagccgttttacgatcaatttcgccagctcttacgatcaatccgctgagcagtctagtttagaatcggggcgccatgagaaagaaggatcttaagaagttgaagctcgcggttcccgcaccggaaacccctatgtctgacttcttgactgcaagtggtacatttcaggatggtgatctccttctaaataggcaaggtttacggcttatttcccaagaagatgatgagagtccatctccaatagagccacttgataaccagtttactctggctgacctagagactgtgagtgtcattggaaaaggaagtggtggtgttgttcaactggttcgtcataaatggacagggcaattttttgctttaaaggccattcaaatgagcattcaagagagtgttcgtaaacaaattgtgcaagagttgaaaataaatcaagcttcacagtgcccaaatgttgtagtttgttaccatgctttctataacaatggtgttatctctatagttttggagtacatggattgtggctctcttgcagatgtgataaaaagagtcaaaacatttacagagccttatcttgcagttatttgcaagcaggttctcaagggattgatatacttgcatcgggatagacatatcatccatagagatatcaaaccatcaaacttgctagtcaatcacaaaggtgaagtgaagatcacagactttggtgttagtgcaacgctagcaaattcaatgggccaacgcgataccttcgttggtacctacaactatatgtcgccagagcggataagtggaagcacatatggatttagcagtgatatttggagcttgggcctggttgtgttggagtgtgctactggtcgtttcacatacttacctcctggacaagaagaagggtggctcaatttttatgagcttctggagacaattgttgagcaaccagcaccttgtgcatcgccagatgagttttcaccagaattttgctccttcatctctgcatgtgttcaaaaggatccgaaagacagaatgtcggccacagatcttttgaatcatgcctttatcaggaaatatgaagaccaaaatgttgatctcgcagctttgctcagcagcttgtcatcacctgtgtaatcataatagacattcaagtgatgacaccctatggtaaaacaatggtttccagattccatgattggaatttagttctgtataagtcatagcttatctcaaactacgtaaatgagtaaaaccaaatgggcattaatatatgctagaattaagctgttgatgtagtattgcttaactggcaatggggagtgaatctccactcaattatgtgatgtcctttatttaagaaaccctaatcataaaacatctgtcgtgctctatttagtctaaaaaaaaaa

SEQ ID NO: 169 - DNA, 3574 bp, Pinus radiata
taggagccggctctggttagtgctactggagaagaggcagggaaaggggcaagggcaggggtaggagcaggagaattgcttagattgaatatggcgctgatgatggagtttggggatgatgctggtattggtgaggagtgggaggataatgagagccagagaatggaaattgacacggggaagggaatagaaacccatttcaatgacatcccagaggtgataatgagcaacatattcagcgccatcaaggacactcgatcgcggaaccggatggctcttgtctgcaggaagtggcatgaaatggagagggcgactcgcgtgtatctgtgcataagaggtaacataagcaacaacttgtaccggctgcccatgtgctttcagtctgttactaaattggatctctcgctttgctccccctggggttatccccctctggatttcaccactccgcacggtaacttcatagggcatcggctcaaacaggcattccccagagtgaacaacatagtgatctatgtaagaagtgcgaggaatatagagaagttgtcctctctgtggccttgtcttgagcatgtgaaattggtgagatggcacaggcgtgccatggatcctgagtctgcagtcggtttgggaatggagcttaagctcctgatgcaaaattgcacagcgttgaagagcctagatctctctcagttctattgttggaccgaggacataccgcttgccttgcaggccgagccacatgtgtcggccaatttgtcaagcctcaacttgctaaagctttccgcggagggtttcagggcccaggagcttgcagccatatcaggggcatgtaggaaccttgaggagttgcttgccgtttgtgtttttgatccaagatacatggattgtgttggggatgaggctcttgttgtacttgccagaaactgttctagggtcagaattcttcatttggtcgatgccactgcatttgaagctctcagaggcgatccggaagatattttctccagcgagaatgccaagattacccgccaaggtctggaaagcatgttctggaatctacctcttttagaggatcttgtgctggatatctctcacaatgtcgcagactcgggccccgctttggaattcctaagctcccattgcaagaacatcaagtctctgaagttgggtcagtttcaaggcatatgcaagggccctgaacccgatggtgttgccttgtgtacaaatttggaagctctctttataaaaaactgttctgatttaactgacacgggcctcgcagccattgcagctgggtgcagtcgtttgggtaaattagagttacagggatgtaggcagatcaccgaggctggtctcaagttttgtactagtcgacttagtaaaactcttgtagaggtcagggtttcatgttgtaaatatcttgatactgctgccactttaagagcccttgaaccaatatgcgagagcgtgagaaagctgcatattgattgcatttgggataagtccattcttgatcaagaaattgcttctcctagtcggaggttgaatccagttggatcttctgccatttccacaagggaaatagctagctatggaatgggaaaaaaccatctagtttctgctggagattgcaatgtcaacagatgggaccagaatccggagagtgcttgggggccatccttgcagttggctcctcctcagttttgccctgacctcaactgcgcaaatttcgattttggttcaagcccttcggatgtaccgatgacaaattggggcctggatcttaacctgactgcaagctcatgctcagggcctttagaaagttccgaggaaagaggctgtttgcctatagaaaatttcttcgaagaacatgaaaaaccgaattcccttggttctgacaggtacgtgccttccgatggtgtcatgtttagaggcatggatgtgaacggaaaagctccacagatggagcgactgtgtcattccaataccggcacagtttcggattcgtcatccacagaatttgtggactttttggggataaatgacaagcatcaagaatggcagaaacttggagcagatattaattatggtatggaagtgatggtcaattcatctcaaatatggggtgtaacaggggaggctagtaaaagaacctcctcagcaaacttagaaggtgagcagtcatggacagagatccccaatcaatacagttatagtgattcgagcagtcatatcagatctataacttggaaaaatctgcaattcttgtcattgtggattcccgtaggagagctgttgtcacctcttgcagcaatgggtttaaaagtatgcccgctgcttgaagagattagtatccaagtagaaggggattgtaggctctgccccaaaccaagagagcgtgcatgtggtttaagttcactggcatgctatccttctttgtcaaagctcgagctcaattgtggtgaggtgataggttttgcattgagcgcacctgctggcaagatggatttgagcctgtgggaacgatggtacctcaatggtcttcgagaactacatctgtcagaactgaattactggcctccacaggacaaggatatgaatcggagagggctttcacttccagctgcaggtcttctttcagagtgtgcagctcttcggaaactctttgttcatggaacttgtcatgaacatttcatgatgatgtttattcgcattccagacttaagagatatacagttgcgggaggattattatccagcccatgaagatgatacaagcactgagatgcgtactgattcatgcaggcgtttcgaggaagctctagctagtcgcggatttactgactgaattaggttttgtgaaacagggtttattgttgattgatctttccaaggtcaactgtggagtttcagaggaagtagtattgtatgatcctcgtgaaataacatcctgaaggtagagcctgcttgtggtgtgcacgacttgcaagacaataaccagaaatttgtatgtcaaagcatcagaagacatacaaaaggatcactgcctttcggtgtcaggggtctcagccatggattttaatattaattgtgtcagtgaaaacttctgccttgatatttggttcgagtaattggagataaagactgattcttcttttaaaaccatttggctgaagactctgaaataaagtatagaatattacagtatgtccactcactcttccagggtttccccgatggatttatgttcaggtgcagcattcctcgtctaatgtgtcagtggttatacttcctttggaatgtatctttcatgagactcactgttcttttggtgaaggggaatcatatgtcaatcacaataggctgctgaggacacagtagaacctagattatttagtgtagatgtacccattgtatcaatgtcaaatgtctaatactcatttgattttattgactggcccatacttgtaaccggttccttgtttcaactgttgctcttttgtccacggttgaaaatgtaattgatgggagaaataacaacataatagaaatacttgcctccaaaaaaaaaa

SEQ ID NO: 170 - DNA, 2766 bp, Pinus radiata
aggagatcggaataccactcaggttaaccacattaggtaaattattttatgtttttaattgtgaaggcagttaacttgtcatcttgttgtttgtcccagttaatcatcgtggggctgaacgatttcagggccatggttttcatttccattctttccaccccatatttttcctggtttctgaactcagaatgacttgatttccccattagcgtggagtcctaggttgcacacatcctcaaactctcattctcaactacgcatttgtttaagaccctcacttcccaaaccccaatttgggtttcttttcaatatttcccctgcgatcgagtacattggagatcagtgagtgacgggcagcacaggggccgaaaggacaattttcctgctttttcttgtttttctggcaatgcagatatcaggcactcgcaggccttgcaggccatgggcttgtgttggttctctatgactgagcgcaggagaatagatctagaattgtttattaatgggaggatcaagataaacagtgggttttttatcagaagcagaggcagatggggcaaatgtggttgacgtacagaccaagctgagaaaaggctgattttttcctctcatttgaagcgctccccatgtgaaaagatttggtatttgtggttccaggcagattcgcagatagttgaggcattggccttgtatcaggacataagaatacagcgtggatctaaaagtgaacggagacaaagaactatgcagcaagatcagagaagaaaagcccctacagaggttgagtttttcactgaatatggtgaagcaagtcgctacaagattcaggaggttataggaaaagggagctacggtgttgtatgctctgcaattgatactcacactggggagaaagttgcaataaaaaaaataaatgatatctttgaacatatttctgatgcaacccggattttacgtgaaattaagcttctgaggctgctgcggcatcctgatattgtcgaaatcaagcacattatgttaccgccctctaggcgggaattcaaagacatttatgtggtatttgaacttatggaatcagatctacaccaggttattaaggcaaatgatgacttgacaccagaacattatcaatttttcttgtaccagcttctacgagctttgaagtacatacatactgcaaatgtgtatcatcgggatttgaaaccgaagaatgttttggcaaatgctgattgcaagctaaaaatatgtgactttggcttagcaagagttgccttcaatgacatgccgacaacaatcttctggacggattatgttgccacaagatggtatagggctccagagctgtgtggatcctttttctccaagtatacacctgccattgatatctggagcattggttgcatctttgccgaaattttgactgggaagccccttttccctggtaaaaatgtagttcatcagttggatttgattaccgatctttttggaactcctcccatcgaagccatttctcgggttcgcaatgaaaaagctagaagatacttgagcagtatgcgcaaaaaacaacctgtacccttgtcccagaagttttcaactgcagacccattagcgcttaaacttttggaaagattgttatcttttgacccaaaggatcgtccaacagcagaagaggctttggctgatccttatttcaaagggttagcaaaagtggagcgagaaccttcagctcaacaaataagtaagatggagtttgagtttgagaggcgaagggtaacaaaagaagatgtgcgggaactcatttttcgggaaatactcgaatatcatccgcagatgctaaaagagtacctaaatggatcagatagatccaattttatgtaccctagtgctgttgatcaatttaagaaacagttttctcaccttgaggaacattatggtaaaggtgcacctgtggttcctttagaaaggcagcatgcatctttgccaagatcatctgttgttcattcgaacactatgccccccttgccagagaaaacaatatcaggtccttcaagggaccgtacttcagaatcccgtgatgaatcttctaggtatattagggaaacagagaagctgcagcatgataggagtgcaggaaatgcactgaaggctcccttgcaaccacctcagaaaatcttgcaggggggtgctgcaaaaccagggaaagttgttggacctttgccttatgaaaatggtagtacgaaagaagtctatgatccaagaaggttgatcagaaatgctgttctaacaacgtctcagtatgccgctcctatttactcatatccaagaagaacttcaaacacaaaaattgaaccgaatgaaaaggaagacgctgagtcaactttaatgccacccaaggcccaatatgttggaattggtgcagcaaggaaagtagctgcagttcagagtgcttcctctcgcttatattaagcaaaatcaatttcctggtaattgcaatttgtagcccatttagacattgttgactgacatcattctttattacttggcatcttccaacactgaagcaaattgagcaacatatcatatctagcatgtgaagaagatgctcatgtacaaaaggttttcccttttcatgatgactgaatatggttcagtatcaagcccaaaagggacaacaaccatgcagtccctctgtactgtaagaagagatgaactcgatgaaattagtattttatggaaaatgtaaatgatttgactgtaaaaaaaaaa

SEQ ID NO: 171 - DNA, 2523 bp, Pinus radiata
atctctgctgctctgtgttggggattttgtctcgatggcgcagcaggaacaacagtagtagcagcagcagcagcggctgctttcagagataaggagatccgcatagattttttagtgtcgagttaaaatatctgaatttcagtacacacatgcgcgcgtatgcacatggggaattcggaagcatccgccaattatgaccacttacgcgtccctcagttggtcctctaagctattgctacagggggttcagacgtctggagcacagtacactagaggatcccgtttagcagactaaatctcaacagaattttgcctgcttttctccctatataacctcctctctctcaccggcttcggttctgatttttcccgcaatggggccttgcaatggccgtttctcagctctgattttgatttccatgactccgcctccttctcgtgtcggcgtcctgatctcgctctttataatgtctctgttactgtgtatttcggcgccctgcatgcacagccctgcggctgccctgatcggcttgagtcgctctgagaaatacaacacagacgggcaagatccgtgccgtctatcgttcctggacacggcggcggctgccatcgacttcggcaggatttaccatcacaatcccgcggctatcctccggccggtgtccgctgaagaaatagcccgttttcttcgggctatttatgcgtcgagggcgctcgcgaccggctatcgccaggaatacctcaccgttgctgccaaaggcgccggtcactccatccatggccaggcgcaggcccccgatgggctcgttattgagatgtcttctctcagaggcgtgcgcattcatgtggcggaccgcgccggcggctactcgtacgccgacgttgctgccggagagctctgggtggacttgctcgcagaggcgatgaagctcggcctcgcgcctcgatcgtggacggattacttgtatctcagcgtcggcgggactctgtcgaatgcaggtatcagcgggcagacatttcgccacgggcctcagatcagcaacgtcctgcaacttgacataatcacagggaccggagaattagtcacttgctctcctgctgagaatgcggatttgttctacgcttcaatgggaggccttggccagttcggcatcataacccgagctcggattatcctcgaaccagctcctcagaaagtgaaatgggttagagccttatacagtgatttcgagcagttcacaagggaccaagagctcctggtgtccatggacgatggcgccgcatctgtagattacttagaaggcttcgtggtcgttaacaacgaggcaatgcgcagctggtcgatctcgttccgcactgacacaccgctcgatgacagcgtcttcaacgacgctggaaccgagattctgttttgtattgagatagcaaagtactttacacaatccgacgacgagacagccgatgtcgacaaggtcacggggcggattatctcgagattgagtttcattcctgggttgatttacagtgtggaggtaccctacgccgatttcctgaaccgagtacgagtggaggagctgaacctgcgatctcgaggcctctgggacgttccgcatccatggttgaacatgttcgtcccacggcgccaaattcaacgtttcaccacttctctgctcaggatcatgtctccggacactgtcaagggcccgatactcgtctaccctgtgaaaagaagcaagtggaataccaacatgtctgcagtaatacctgaggacaaagacgagatcttttacgcagtgggcgttcttcgatccgcagacccactgtgcttggccgggtcttcctgcttaaacgatttgctatcacagaaccagcaaataatcgatgtatcgacaaacgcaaacgagattggcaacgataagaccgaaccaggcatgggcgcgaagcaatacttagcccaccattcccagcaatggcagtggaagaatcattttgggagcaaatggggaatatttctgcagagaaaggcgagatacgatcctctgaacattctcgctccaggacaaaggattctcaatagaaaccaccgagaatgacctgaccatgatgatctgtccaaggaaaccagagatctcgctaacagcaaggccagtagtataatgaatacagtagaatattatatttttatttctgtcctccctgtaagatccctggcacataattacaataaaatttatactgaactaaactttttggcattaccccaaggttttctccatactttggtccatttattaggccagctcacagtgtgggtacaagccagtctgcaattgcagttcagcagatgcatcatcacctgtaaaaacagtttcaccgatttttttttacagtgtagagcatcttcaggcacaaggactacagtattacggcggatgatcagtatagctgctgagctgaaattcgcggatgatttgtacaggagaattaatgtaatacaaaaggatatttttactaaaaaaaaaa

SEQ ID NO: 172 - DNA, 2510 bp, Pinus radiata; identical to SEQ ID NO: 126

SEQ ID NO: 173 - DNA, 1243 bp, Pinus radiata
ctgcaatggcttcaacacctgtgtcttcctctgcttctcagcccaatttacttcgccattacactcccactgtcacagattgctcctcctcaggctcctctatccccgttgtggatttgtctgcacaaaaaaccagtgtcgtccaggccctggttaaagcctgcgaagactatgggttcttcaaggttgtgaaccatggaatctcgcaggttttaattgatgccatggaggcagaagcggagaagttattcgctctgccattgtctgaaaaggagagagcaggacctgccgacccgtacgggtatggcaacagaagtattggtcgcaatggggatgtgggttggattgaatatctgctgttcagatctgattttcaatatgttcagcagcgttataaggcaatttcgccagataattatatcaatttttgtaatactgccagcaaatacataagtgcaaccaaaaagcttgcatgtgatatactggaactgctagcagaagggcttgggcttcctgaaaatatattctcaagttttctaacagccgaggggagcgactctgcattcagactcaaccattatccgccatgcccggatccttctaacataataggattcggagaacacaccgatccccagattttaaccgttctgcactccaacgatgtcggaggattgcaggttttatccagagatggaaagtgggttaccgtgtccccggacccgtcctcgttttctataaacataggagactgcatgcaggtactgacaaacgggcggttcaagagcgtgaggcaccgcgcggtgacaaacacgctgcgttcgcggatttcaatgatgtttttcggtgctccggcgttggatgcgaccatcgtcactccttcccagctagtggacgaagatcgtcccgcccagtacatgccattcctctggtctcaatacaagaaatccatctactgcttgaagttgggacaaactcgtggcctgctccagaaatttcaggcttcaatggtaggagtaggtgtggcttaatccactcaccaaattttattccggtggttacaatccgatgatataatggagggggagttgcttgatcaaatagcaaacacagtcagatgatacagcggagaaattgttgtacatttaagatttttaatacaaaaagttttggagtaattgagtaaattatccaatatggtatttgacctcctaaacaaaatatttacaaatcaaaaaaaaaa

SEQ ID NO: 174 - DNA, 1198 bp, Pinus radiata
ttccgccctgcctatcctactatcctcccgtttcagatccgtttcagttcaaatgggttcaagcggtcgccatgagaatgaagcagagaaggtggttagctgttatgaaggggatacaatagagcaaaacagggtggatttgatgagaagtattattgaagttaagtacccatctgcaaaggtgacagatgatgctacactcagacgtttcctacgtgcacgagatttaaatgtggaaaaagcttctcagcttttcctgaaatatctaaaatggaggcaggcgcttgtaccccttggttatattccagagtcagaggtctccaacgaactcaggaagaaaaaggtttatattcaagggttcgacaaacaaaggcgccctattgaagtgattcttactgcaaggcattatgcctctgacagggatctagaggagttcaaacgactcattgtctatggttttgacaaattatgtgccagcatgccaacaggattggagacatttgtcgtcatagcagatttcgagggttggggctatagtaacatggatacccgtgcctaccttgcggcacttgaaattttgcaggattgttatccagagcgccttgcaaaggcatttatgattcatgtaccatacctattccagacagcatggaagatgatttctccgtttattgacaaagtaaccaagaaaaagattatttttgttgaagataaacatctcagatcaaccttactcaatgatattgatgaaagtcaattgccagaaatttatggaggggcattgcctttagtaccagctcaagattttgtcatacccaattggtcttagatagatctagttaggataattgttatcttttctttggttgcataattttataaatttaatttttttttatccttttacatttaaaaactggaaaagctcgaacctttttaatctcactaacaatttcacttaaacatgttggaacctgccatgcttctgtgttatctaaacttgttattataacaaccatggaaatctaatatccatgcattgccttccctatcataggctaatattaggaagtctttttggtatacagtgatattcaatgttaaatggagtgtatgataagtaataaaatatataatatttcctcatatcacatgattatatgatattgtatcataaaaaaaaaaaaaaaaaaaaaaa

SEQ ID NO: 175 - DNA, 1406 bp, Pinus radiata
cttgaggagagatttgagagtgtttgtgaagggaagtgttgttgtttgtgtgtgggtttgttatatttttcaagaaagatggcaattccagtcattgagatgggtagtctgattggaaatgacaaagagagattcatggcagagatgggaaaggcatgtgaggaagtgggctttttccagcttaaaggccatggcataccagttgagctcatggagcgcgttaagaaagtgtgttccgagcattataaccatgtcagagagccaaaatttaagaccgagtcggtgccagtaaagttgcttaacaagtccctcatggaagcagagctttcttctagcgagccaaagaaggtagaaaatgtggactgggaagattgcattgtcctccaatacgcccaagaagactatccatggccctctgacccaagcgagttcaaggaaacaatgatggaatttggcaaagagatcaccaaattggctgagagcctgctagaattactaagtgagattttgggtttggagaaagggtatctcaagagaaccctgtcaggaggtgatggccctgatgacaaggctttttttggcaccaaaatcagccactatccaccatgtccaagaccagacctcgtggaaggtctgcgcgcacacactgatgcaggtggcctcattctgctgttccaagatgacgaggtgggaggtctccaggttcttgacaacactggtcgttggatcgatgcaccaccaatgaaagacacgttggttattgatattggtgatcaattggaagccatcagcaacgggagatacaggagcgcatggcatcgtgtgttggctactgacagtggcaacagaatgtcagtggcatcgttttacaatccatcgcttgatgcagtcatttccccagctccagagctcctttcgcagcccaagaaaggctcggagctatcactgtacccaaagtttatgttcggggattacatgaatgtttatgctcagcagaaatttcttcccaaagagccacgattccaagctgtggcagccttgcagtactgagatcaaataatattcacaaagcttatgtttataaatacagtgtttctcggattttcgtatgttttctcaaagtcgtaataaatttgtttagaaattgttgtactgttaatgcccaaccggtctaggccatggccatgaatgaaccaggtgtgaggctccagtaagctatgtcgtccaatctaggtcaggttgctgcatttctatgtctgtattgagtcaagttgctgctgtcatactaaatgttatgttggttttcttggtaggcttgggaaacgttctgtacaaaagaccattttgtattcctaggctggttctgtttacatggatttggattttctggttaaaaaaaaaaaaaa

SEQ ID NO: 176 - DNA, 1896 bp, Pinus radiata
caggaatggcgtcctatattcacatcaagtcttgaggctccattcaaacgagcattctggtactgagtaatttcaggagatttggctacatgtacgcaatctgccactggaattaggcttgaggatgatggaggctttaccagatcaggtggtgtgggaagtactagatcgaattaaagaaacacgagacagaaacactgcagcccttctgtgcaaacgtttctatcaaatcgagaaaaaccagagggaatatttaagggtggggtgcggtttaagcccagcaattgaagccttatccgcgctctgtatgcggttccctaacttagtgagagtggagatagggtattctggatggatgtcgaagctaggcaagcagttggataatgaagggcttaaaattctgtcacagcattgccctaacctcactgatctcactcttagcttttgcacatttattacagatggaggtctggggtacctaggttcctgcactgggcttaaggccttaaggctgaatttcactccaggaataacaggttgtggaatactgtccgtggttgtaggttgcaaaaaattgtcaactcttcacctgactaggtgcctcaatgtaagcagtgtagaatggctggagtatctaggtcggcttgagagtttggaagatttggctatcaacaattgccgggctattggagaaggtgatctagcaaagttggggtacggttggaggaacctgaaaaggcttcaattcgaggtggatgcaaattataggtacatgaaagtatatggacgtttagctgtcgaaagatggcagaaacaatgggtagcatgtgaggctctggaagatttgagtcttgttaattgcctcatcagcccaggtagaggacttgcttgtgtgcttaggaaatgtcaagctttgcaaaatcttcatcttgatatgtgtgttggggtaagagatgatgatttgataagccttgcccagcaatgccccaagctgaaaaccttgtcattacgagttccttcagatttctccgttcctatcctaatgagcaatccactgcggttgacagatgagagcttgaaggccatagctcagaattgctctgaattggaatcagtttcaatatcattctctgatggagacttcccttcctcatcttccttcagtcttgctggcatagtttcattaattgaagcatgccctatccgggttttagttcttgaccatgtttattcattcaatgacagtggcatggaggctctttgtgcagctcactttctagagatccttgaacttatacaatgccaggaggtcactgatgaagggctgcaactggtcaagcactttccatgtttgagtgtcatgcgactttgtaggtgcttgggtttgacagatattggactcaagcctctagtagcttctcataaattgcaaaagttaaaggtggaagattgccctcaaatctcagagaaaggcactcaaggtgctgcaaaggttgtctcctacaagcaagatctctcatggatttactgatggatggttgaccttcattttctgaatcgtagaatggtccatccatggatatcatttgaagaaatcagtgcttattgacaggcattttatcaattagaaggacaacttttatgaaagcaggataattctaggtgtagtgctatatgtattatgaacaaattttttgtctcaaatttgcttcctgacagaatatgcttggagtggcctttcgcatatatgtacatgcaaggctgtctagtggttagctcttatccatatgctggactgtttgagcgtttcaagagatcagctttccttgacttgtatattttctatgtttgatttcaggttcataatgtaaatacctttcccgttgaaaaaaaaaa

SEQ ID NO: 177 - DNA, 2333 bp, Pinus radiata
atagctatggctcttcagcttatggaaatggatctcaaaagcagcaccgacatggaaatggtggaggaggtataagttattggaataagcttcccaaggtcgggtgaagaaggtataatggaccccatggaaagggctgccaaggtcctgggatcgagtccagggcacaaaaatatgatgggctgttcttcgtcaggtgtgaaggtagaacctgagattgatgggcttctggcaaacgctgggtatactgtaaaggcctctgatttagcccatgttgcacagaggctggaacaactggagagcattatggggacggttcaagacccgggaatatctcacttggcttccgaggctgtgcattataacccatcggatttagctggctggatcgaatcaatgttcggggagcttaatccaggcgcagacatgccagttccgtttggggacaggggatctctgatcgattcttcacaggttcataagccgattcaggatgatcccagtctttctgctatggacttggcgctcattcatgaatatggcttgcagtttaatggaagccaagcatctaaccctcagggtttttccccggattctgatccctctgttagatgcaatattttctctggaccgcctctgcgttctggggattctaccacacacacgaactttcaggcgcggagctttagtgcccagtccagcgacgagggttcgagtctctctactacccgcttgggaaccgcacaacagagcatagataatggagcgcaagaatcagggattcgcgtggtgcacttgcttatgggatgcgcggaggctatacagagaaacaatttgaaggtagccagcaatttagtcagagagattcgaatgacggtgaattctgccccctgtggagcaatgggcaaagtagcttcccactttgttgaagctctggcgcggcggatttgtggattgaatggcgcagaatcgaatatgtcacaggcagatgcgcaatcggagattctctaccaccatttctacgaggtttgcccttatctcaagttcgctcattttaccgcaaaccaggccattcttgaagcttttgaagggcacggcagcgtccatgtgatagacctaaatttgatgcacggcttgcaatggccggctctgattcaggccctcgctctcaggcccggcgggccgcctcttctgagattaacagccattggaccccggcagcccgatggcagagacgtgctgcaagaaataggcatgaagctggctcagttcgccgaatctgttaacgtagagttcgatttcagaggtgtcatggccgataagctggaggatataaagccctggatgttccaggtgaagcctggagaagtagttgctgtcaattctgttctgcagctccatcgtttgctttacattgatgcccctacagggtcttcccccattgatgtagtcctcaagtccatcggcagcctgaggcccaagattgtgacagttgttgagcacgaggccaatcacaatggacctgtttttctggacagattcgtggaggcattgcattattattcaaccatgttcgattctctagaagcatgcaatgtgcttccaaatagtatggagaaatttttggcagagttgtatattcagaaagagatttgcaatattgttgcgtgtgaaggtcgttatagaatagagagacacgaaaccctttctcattggaggatacgcttgggcagagcaggtttcaggccatcacatttgggctccaacgcatttaaacaggcaaggatgctcttgaccttattttctggagaaggttacactgttgaggagaataacggttccctaacactgggctggcacagccggcccctcatagctgcatctgcatggcaaggctcctagggcttagggttcagttagttgtatcatttcttagcatcttgcaggctcagtaactgtataagaggagaataaatctcaaagttttcaagtttttaagacagttaaatactcctatcctgtggtgtctggataaacataccagaatcaatgaatgcttcacaacaatgtgatacgtctttctctctggataagcacattagcgttcaggatgaaatgctggctcgtaagataaatgctaccagaatgattcaaaatggccatggctaggctaggctcatctaagcactgatgtaaagataatgagtcaatcatttgatgtaaaaacaatgagtcaattatttacttattgtatggtgcttaacatgggcagaaactcatgcttacacctctttctttttctgaatgtattttcttctccttcaaaaaaaaaa

SEQ ID NO: 178 - DNA, 4104 bp, Pinus radiata
ataagcttaagcttataggacaggggagaggaagaggaagaggggcgaagggggaaaatggcgtcaaatagcaggtatacgcagagccaatcaacaggaagcaacaataggagaagcagcactaatactaacactaccaccaacaaagcaacggcgatggctcagtacaatgcggacgcgagattactccaagtcttcgaacagtccggggaatcgggtaagtctttcgattacacgagatccgtcaagtccacaacagagtctgttccagaacagcaaattaccgcatatttatctcgaattcaaagagggggaagaatacagccgtttggctgtgtactagcagtggaggagaccacttttaggatcattgcttacagtgagaacgcagtggaaatgctggatctggcgccccaatctgtcccgagcatggaacaacctcaacaagacgttctgacaatcgggaccgatgttcgaaccctgttcactgctgctagtgctcactcattggagaaggcagcagtagcccaggaaataagcctcatgaaccctatctgggttcattgtaaaaactccagaaaacccttttatgcaattgtgcataggattgatgtaggcatggtgatagatttggagcccttgaggactggggatgcgttcatgtcagcggctggtgcagtccaatctcagaagctcgctgtgagggcgatttctcggctgcagtcacttccttgcggtgatgttggcttgctgtgtgatagtgttgtggagaatgtgagggaactgattggttatgacagggtcatggtttacaagtttcatgaagatgaacacggggaagttgttgctgaaatcaggcgttcagacttggagccctatcttgggttgcattaccctgccacagatatacctcaggcttctcgctttctttttatgcagaacagggtgcggatgatctgcgattgcatggctactcccgtgaaggttatccagtctgaggaattgatgcaacctctatgtttggtgggttcgacgcttcgggcaccccatgggtgccacgcccaatacatggccaacatgggttccattgcttcgcttgttatggctgtgattattaatgggaatgatgaggaagggggagggagtggacgaaattccatgaagctctggggtttggttgtgtgccaccatacctccccgagggcggttccgtttcctctccgctatgcttgcgaatttctgatgcaagcattaggtcttcagctgaacatggaattgcaattggcagctcagttaacagagaaacacattcttaagactcaaacgcttctctgtgacatgcttctccgagatgccccaatgggaattgtaactcagtctcccagtatcatggatcttgtcaagtgtgatggtgctgctctttattatggaggtatgtgctggatgttgggagtgaccccaactgaagctcaaatcaaagatattgcagactggttgcttgaacaccacggggattctacaggcctgagcacggatagcttggcagatgctggttatccaggtgccgcctctcttggggatgcagtctgcggcatggcttcagctagaattacttcaaaagattttcttttttggttcagatcccacactgcaaaggagatgaagtggggaggagtaaaacatcatccggacgacaaggacgatgctcgacggatgcaccctcgttcctctttcaaggcattccttgaagtggtcaaaagaagaagcttaccatgggacaatgtggaaattgatgcaattcactcgctacagcttattctacgaggctcgtttcaggatattgatgacagtggtactaaaactatggttcattctcggctaaatgatttgagattgcagggcatagacgaacttagctccgtggctagtgagatggtgcgtttgattgaaacaactacagcacctattttggctgtagattataatggacttgtaaatggatggaatgcaaaagtggcagaattgacgggcctcccggttggagaagccatgggcatgtcccttgttcaggatcttgtttttgaggagtctgtggagagggttgaaaaaatgctacacaatgccttaagaggggaggaagagaaaaatgttgagatgatgctaaagacctttggcccacagaaggagaaggaggctgttattttggtcgttaatgcttgttcaagcagggattttacagacaatattgttggagtatgctttgtgggccaagatgttaccagtcaaaaagtggtcatggataaattcatccgaatccaaggtgactataggtccattgtgcaaagccccaatcctttgattcctcccatatttgcttcggatgaatatgcctgctgctctgaatggaatgcagctatggaaaaagtaacaggctggactcatgatgaagttattgggaaaatgcttgttggagaaatttttggtggttgctgtcgtctgaaaggtcaagatgcagtgaccaagtttacaattgtgctgcacagtgcaatcgatggacaggaaatagagaagttcccatttgcattttttgacaaacaagggaaatatgtggaagcacttctaacagcaaacaaaagaacagatgcagatgggcgaattactgggtcgttttgtttcttgcagattgccagctctgaactgcagcaggcattagaggttcagaggcaacaagagaaaaaatgttttgcaagattaaaagagttggcgtacatacggcaggaaataaagaatcctttatatggaatgatgtttacccggaaactgttagaggagactgatctgtctgatgatcagaagcaattcgttgaaacaagtgctgtttgtgagaggcaaatgcagaaggttatggatgatatggatttagagagtctagaggatggttacatggagttagacaccgctgaatttattctgggaactgtcatcgatgctgttgtaagtcaaggtatgattgtactaagagagaaaggattgcagctgattcgtgagattcctggcgaggtaaagacaatgcgtctttatggagatcaagtaagattgcagcagatcctggcagatttcttgctgaatgtgttgcggtttactccttcaccagagggatgggtagcaatcaaagtatttccaaccttgaaacagcttggtggtggtttacatgtcgttcacctagaattcagactttgttgtatgaagagagccttgatgccaagatcattcaagaacccactctctttcctccagataaagatataggataacacatccgggaccgggccttccagcagaacttgtccaagatctgtttgatagatcacagtgggccacacaagaggggggttggactaagcatgtgccggaaacttctcaaattaatgaatggtgatgtgcagtacataagggaatcaggaatatgctatttccttgtgaatgttgaatttccaatggcacaaagagaagatgcagccagtataaaatagacgtggattccttgtatcatgttctgccaaacaactctaagggttccttttcttcaactgtagtgcctctccagatttggtgcaagcacagcagagaactccatgtatatcaatggtatgaatgcaagactgagcttctttggcttcacagaggattccacttgtaatgtatgctccatttttctgcttggctttaatgctggaaacatcgaaagcattgtatcacttgacttgagaattcacggcactgggacggcttttgtaaaagcttcaagttgttaaatctagtgacacaacctctctacatgttcctcatgaatactggtaatctgtgcttctgaaggctggtaaacattattattgtgtaatccattagcaaggtccttgacagcattttaagctgtaagtttagaaggtttcaaattaactgttgtaaaactagcagagatccatcatagttatagatatattaagcactgaaagggataaaaaactgaacatgcaaaaactccaagtttttgcaccctcaaattctatttaataaacagaggtttgcacggcaaaaaaaaaa

SEQ ID NO: 179 - DNA, 1243 bp, Pinus radiata
cgaggctccacccttcaaaaaaaccaccatttcttttgattagtaattttggggtggagtgcaggcatcgaataattgaataggagtaaatcgatttggagcgtggccgaacggaaaacgatcaatttggtttcgtgaagagaacagaaagagaaacgatttgccagcccatcctctccgtaacttttgacttttggaatcctgatcggagcatcttcggacggacgttaatggcgactgtgggcaacaagaatgtgcaggccaaacttgtgcttctgggtgatatgggggctggtaaatctagcctcgttctgagattcgtcaaaggtcaattttttgcctatcaggaatcgacaataggggcagcttttttctctcagacactagctgtgaatgaaaccagtgtgaaattggagatctgggacactgctgggcaggaaagatatcatagcttggctccgatgtattaccgtggtgctgcagcagcaataattgtttacgacattacaaatctagactcattcgttcgagcaaagaaatgggttcaggaacttcaaagacaaggtaatccaaacatggtgatagcacttgcaggaaacaagtctgacatgatagagaatagcaaggtttcaccagaggaagctaaagtttatgctcaagaaaatgggctatttttcatggaaacctcagcaaagactgcacagaatgtgaatgagctgttctacgaaatagcacggagattaccgaaggccgagccagtgcagcatcctgctggtatggtgcttgctgacaggtctgcagaaagagcaagaagcaattcttgctgctcataatataagggacataaatatcaatgatcagaggcctggaaaccaagctgggataatatttgtattgtgctatgcttgaatttaagtagattggagctgtgagacagatgattatattctcgacttttctgttgctagactggctttattttgggggaaaatcattactatctgcatatctttgcattttccttaggttactattttttcgtagatcctgggcactgttgaagacttgccccgaagatccctgtagttaaactgtacataatgtatgccaatgtatgtaagaaattgattttatcatttgcagcttctttaatttatgcatgtgagtaaatgcttgtaataataaagttttggtcagttctgctgctttccaggttaatattttggaactgtgaaaaaaaaaa

SEQ ID NO: 180 - DNA, 1150 bp, Pinus radiata
gtcgcgggttcggattcttttccctttcgtcacaatggcggattcctcagtgcgcagcgagagcgtgtacatgtcgaagctggcggaacaggccgagcggtacgacgagatggtggagtacatggggaaggtagtgaaggccgcggacgtcgaagagctggcggtggaggagagaaatctgctgtctgtgtcgtacaagaatgccattgggtcacgtagggcctcctggaggatcgtctcttccattgaacagaaggaggagagccgagggaacgaggaccgcctgcccctcatcaggcaatacaggctcaaggtggaggccgagctgagcggcatttgtgacagcatcctggggttattggatggctatctcattccctctgcttcttgcggggaggccaaggtcttttatctcaagatgaagggagattacaatcgttatctcgcggagtttaagaccggggatgagaggaaagaggcagcggatggcacactggaggcctataagaatgcacagggtattgctctggttgagctggcctcaacacatcctataaggttgggacttgcactcaacttttctgtgttctactatgagatcatgaatatgccagagaaagcatgtgcccttgctaaacaggcttttgatgaggccattgctgagctggatacattaggtgaagaatcttataaggatagcacactgatcatgcagcttttgagagataatctgacactctggacttctgacatgcaagaacagttggatgattcctagtgaaacagataactaagaaggtgcatgatcctctggttcaagttgagatagaggtgccgcactcattagtaggtttatcatatggaggtggactcaatgacagtttggtggttttattcattttagtgagtggaaggagaggacatttttatgggtctgccacagaaattgatggtccggccaattgtttggatgatgtattagtggtacattgctgcaatactttaatccagaaattcattactaaatgataactagacacatgtggaaggattatcagattttgttggattacactggtttcagtgtagtttgagactttgtgatccaaatcaagttttataatattcttattcatagacaaaaaaaaaa

SEQ ID NO: 181 - DNA, 1690 bp, Pinus radiata
gggaattcccattctgcacatgcaatggacaatggaatgatggtatggatagttttagcaggggtagtggcaatggcagtgtggtatcttttggtacagcaccaacagcctaagcagagccacaatgttccttgggagactcttccaccgggggctgtgggatggccctttctcggagagatcatctctttctatttccgaacaccggattttgtgaagcagcggcggggaaggtatgggaatttgtttagaacgttcctgataggatatccaatggtaatctcaacagatcctgaggttaacaagtttattctgaataatgatggccggctgttcgttcctgcatatccgtcgcattggtcacagataatcggagagtgcaatatctttgctgctcgtggagactttcacaagagaatgcggggagctttcttgcatttcatcagtatttcggtagtcaagaatcggcttctttcagaaatacaaaatatcataactttctctctcgcagggtgggaaggtagaaatgtgaatgtgttgcatgaagcggaagagatgatattttcggtcatggccaatcacatgttaagtctttcagcgggcacagcactggagagtatgaaacgcgattttttggttatgatgaagggacttcgcagccttccgttgagagtccctggcacaacgttttacaaaagcttgcagaaaaagcaggtgttgtttaaccaaatcaaaagcattattgaggagaggaaattgaatatgtcagcctatgattcatatgacgacttgttatcatccatactaagaagtgcatcagaaaaagaattcacaacaacccagatcgtagatttaattgtgcagtcggtgattggttcgcttgaaactacaccaaagataatggcttcagtggtgcggcatctatctgaaaatccacatatcattatatatctcaaggaagaacacgaaacgataatccaagccaaagaaaacaaccagagtctatcatgggatgactataaatcaatggtctttactaaaagtgtgatcaaagagactttaagatttgggatgcaacctctcaacaatataatgtttaaaaagactctccaggatgtaaaaattgaaggatatacaattcccaaaggatggacatgcataatatatgatttagtctccgacatggataccaagtactgcaaagaccctctttccttcaatcctcagcggtggcagagtaaggaaatgaatgaggtgccctttttagcatttggaggtggtcctagactttgtcctggatatgagttggctatgttgactatgtcatttttcttacatcatcttgtgacaaaattcagatgggaatatcttccttcgaaatctgagttaaggtggtttgattcacccttgaactcagtattcgattgcaggatccacgtagagaatcgttgaatctaaagttagtgagatgaacaagcaccaaagtttggtagttggaaagactaaatgaaatcattatgagtatattctttttttattgatatttttaaattaaaactgatgagatgaacctttgatactcctttgttgacatcaaagagtagattgaaataattgtcaatattgttttattatttgtagataatttttttggttagctgatattttaaagctaaagttaaaaaaaaaa

SEQ ID NO: 182 - DNA, 1228 bp, Pinus radiata
cttgaatctgccatagccttatcttcagctgcagttgaagctggggttttgcagatttgggaatggcgatattatacgcattggtggggaggggaacagtggttttagccgaattcagcgcagtgggtgggaatgcaggaacagttgccagacgaatcatggagaagcttcctctccaagatcgcggagaaggagaaagtcgcctatgttattctcaggatcgccacatcttccacatattaagaggatccgatggattaaccttcctctgcatggccaacgacacctttggcagacaaattccatttgcatatttagaggatattcaaatgagatttatgaagacatatggccgtgtggctcaaaatgcacttgcttatgcaatgaatgatgaattttctagagttctgcatcagcagatggagtatttctctagcaaccccaatgcagacaccttaacacgtgttaggggggaaatgaacgaggtacgcacagttatggttgaaaacatagaaaaaatcctagaaagaggggatagaattgaacttctggttgataaaacatcaactattcaggacagctcgtttcatttcaagaagcagtccaggcgactacggcaagcactttggatgaagaatgcaaagcttttggcttcattgacttgcttgattgttgtgcttctgtatatcataattgctttgtgttgtggtggtataactcttccatcttgtcgatcatgattttcacaaatcttggccatggaactttcggatgatgttctgtttgcttgtccgtctttcaaggctatctatgaaaacatcatcagttgtgtgccagacccaatctacagcttatgatggtgtaaaaaggctgttttcttggagatcagttagactgatgcaatgaaattttgctcaagaatctcaggctacttggaagcttggtgtgtggaggaaggcttctgtatttatgagagatgttttcatttgtaatgtctgctcttttgcagattggtatagtgcacaaggtattaatactgcacgcgcttctgattcattgattaacccatggatataattttaatggcattgataaaaacaacaatttgatcgagttgtatggcttaaatggataaacatattccgataaattgattgagtgtaatttcttatttgaaggaaattctgtcttagaggccccatattcattgtgtttatcaaaaaaaaaa

SEQ ID NO: 183 - DNA, 1514 bp, Pinus radiata
gccacggttgcggtggtgggatgctctccagcgctacctgagaagtctcttctttacagtatatttaagagggaaatcgcaaaatctggcatcccattatgcggcgaagggtttgagctgagagcatgggcattctgccacggatactgaagtcgtcccgccttttctgagatcaattgatacacagaaattttattcgccccgtgttgaagggtctggaggagctttatgtggtaggcaagattgaattccgcatcaaagctactgatcagcagggtttattggtttccagaattggcaaagaaatgggggaatttaagaaatggaagcggtgtaattcacttccatcaccgataaattccttggacgatgggtgcctaatgcgcatattttcttttctctcccctttgccagatcgatatagtgctgcaagggtttgttctaggtggagacatctggcatctgaccctcgaatgtggttacgtgtggaaaaatcgtgcaatgcattggctgagtcgggtatcttttcaacgattgaagatgcagttgttgctgcaagaccaggagataccatattaattgctacaggagtagttcatatggcctgtaatattcaaatagtcaagcccatttgcctggttggtggaggttcatcaccagatgaaactgtgcttgtttgtccgcggggctttgatagtgccctagagtttctatccactggaaaagttgccaatcttaccataaaagcagaacttggaagctgcttgctacatagaaatggacgtcttacagtggaaggctgtgtactacagtgtgaagaacatcccttggagcacttatgttgtccaattgtcagcactgctgatgctttagcccctcctagtaccttgtcctctgtcatgaaggggggaagttccatgtctgttatacatactcgaattaaaggtggtgctaaagcagttttaaccaatgggagcctcactctgcagcaagtcagagttatatattcaccgactgccctgtttttctggtttaatgtttcacaaaaatccctgacagatattgatttgccaccatttatatgcaaagcttgagttgtctgtggaggttgtcagcatttgcagtttctagcttattaggtgcgacttcatatttgtaacattaaatcctgttatcttacaatttacatagtatcctgggagtctcttttaatttcaaatatggctgtgggcatggaggtgtacaaaaaagttatggatctgaaacttttgttttctttgaatatacaaactctgagttgcctttaagcccggaggcataatttgggtgtctctgagttggtagatcatcagggcatagctttcataaccggtaatggagtatatgttccatgcctaacaggtattgagattcaggtctatgtagtagtttatcgtatacatcaatctctttggaaaaaagagatgccagactttaaatgattcaaacgagcactttcatcaagaaaaaaaaaa

SEQ ID NO: 184 - DNA, 2196 bp, Pinus radiata
gccaacttctaacttcttggaatcttcttggaatgccctagatgcgttttagttaccttccgccgctatctttggcgccttccactgtgggtttgcagatacattaatctgtagtgctggggacgaaggattgttagcgcttgtatccctgagaagttcggataccttgcatcacttcagaggcattactcttttgtaattccaacatcatgggatcaacaaacaaccagtcagagagagcattctccatcaagctatggcctccaagtgagagtacacgcttgatgctggtagaacgcatgactgataatctctcttcagtttcattcttttccagaaaatatggccttttgagcaaagaagaagctgcagaaaatgcaaagagaatcgaagagacagcatttcttgctgcaaatgatcatgaagccaaggaaaccaattcagatgatagctccgtagtgcagttctatgcaagagaagccagtagactcatgctagaggcccttaagcgaggacccacaagccagaaacaagaatctgagaaggaactaacggctgaaactgttgaagtgaaggagaccatttttgacatatcaagaggtgatcgagggtttgtcgatggaacccttgctgaggagctcctgagaccattgacagaggaagggaatagttataccaagatatgcttcagcaaccgaagctttggtctcgatgctgctcgtgttgcagagagggctttgatggaagttcagagaaatctgactgatgttgatctttcagattttattgcaggaagacctgaggtcgaggcccttgaggtaatgaccatatttgcgtctgttttacaagggtgtgagttgaggtccctgaatctttctgataatgcactgggtgagaagggtgtaagggcatttgggcctctgttaaaatctcagaaaacgttggaggaactgtattttatgaacaatggaatctctgtggaggctgctagagccatctgtgagcttctgccctctgttgagaggcttagggttctgcatttccataataatatgacaggggatgatggagcagagcccctttcagagctcgttaggaactgcactgcattggaggatttcagatgctcatctactagggttggtgctgtgggtggtatagctttagtaggagctctaggagcaggaaatagattaaagaagttggatttaagggataacatgtttgggaagaagtgcggggttgctttgagcagagccctctcaccgcatttgggtcttacagaggcttacttgagctatctgggttttcaggataaggggacaatagctcttgccaacagcctgaaggaaggggctccgtccctcaaggttctggagcttgcaggcaatgagattactgtgaaagcagctacggcgttggcagagtgccttggtttgaaaagaatgcttacaaagttagttttgtcagagaatgaactcaaggacgaaggatcagtgttgatctgcagagcacttgaggaaggtcacgagcatctgaaggaacttgatttgagttcaaattctatcagtggagtaggggcgaaggttgcagctgagttagttgtcaataagcctgacttcgatctgctgaatattgatggaaattgcatttcggaagaagggattgatgctgtcaaagatgtcctgagaagaggtgacaagggtgttaccgtgcttgggtctctggaagataatgatgcagagggcgaaggtaatgactatgaggacggggacgaggatgatgatgaaaatgagagcagtgatagtgatggtgatttagtggccaaggttgaggacctgaaaatgcagtagcgccacgcatagtcttcgacatacattacaaggacaaatttgggtcttcatttgctgtgaaaacgctgatcccgtgaaggcaaactttcagagttttaactgctgcagataagtccctttacattaaatgattggaaattctatacccggctaaatgttgttttgtgaacaaatgagaaatttgattgtgcagcttttgactgccctagcttaagttccgtttctagtatttcacgtttaattatggttcagttagaatatgtttatcaaattcttcatcattcctaatgatgatggttttgggtattcaaattccttttaattttcttgcttaaaaaaaaaa

SEQ ID NO: 185 - DNA, 1402 bp, Pinus radiata
cgttctttagcccttttgttgattgtatgtgttgcacagcctttcaggaggaggagaagctagcgggaaaaggcgcgccgttgctgccgaggtttggccttttggaaacacggatctctgcgtcccttgacggcattgaggattttgatctttcggtttaggttttattttcagggaaaatgtcgcctgcggagtcttctcgtgaagaaagtgtgtatatggccaagcttgctgaacaggcagagcgctatgaggagatggtagagtacatggagaaagttgccaagacagtagatgtggaggaacttactgtcgaggaaaggaatctgctgtcagtggcttataagaatgtaattggagctcgccgggcttcatggaggataatttcctccattgaacaaaaggaagagagtaggggaaatgaagaacacgttactatgataagagaatacagaggcaaggttgagtctgagctcagtaatatttgtgatggcattctacgtcttctggatacacatcttattccgtcatccacatctggtgagtccaaggtattttatcttaagatgaagggtgattaccatcgatatcttgcagaatttaaaactggtgctgagaggaaggaagctgctgaaagtacattgcttgcatacaaggcagcccaggacatcgcgactgcagagttggctccaactcaccctatcagactgggactggcccttaacttttctgtattctattatgagattttgaattcaccagatcgtgcctgtacacttgccaagcaggcctttgacgaggcaattgcagagcttgatacgttaggtgaagaatcttacaaggatagcactttgatcatgcagctccttcgtgataacctcacgttatggacttcagacatgcaggaggagactggaggagatgaaatcaaagaagctccgaagaaagaagaaggtgatggacactgaaggtgatggacgctgacatcttttttatgaatgaaatcgattaggatggtgaaggggatgaacgtcaatgtttatccgtaaatgactgtcaagtaggttagattcatgagatatggtcaaatatgttgtattagaggttttagagtgtttttgtggttttctgcacgattgtgtgctaagggggattcagcaaattctcctataaaatctgctgccctgcaagattttattgttgcagggtactgctttgtactccaatcataccatggagggcacacttaaagttgttatttaagtgttattgatgtcatttggaaggatccctgcttgtcagtggatggatatggtaccctgcagacctgggattgtaataacatagtggataaattactgcaagttctaatattatactgtgatgtgcaccaaaaaaaaaa

SEQ ID NO: 186 - DNA, 1151 bp, Pinus radiata
cagattttgcatgctctgtcttgatctctgtgcattggccaacccaaagccaggccattttcatctgtataggtgttgggtgacgtgaaaggggctttctccggtaaatcttatatttaccctttgaaggcctaaacctttcgcactcctgtactcaaatttgatttttaccatttgggtctgtaatggagtgtcattgattctgaaacctttgggggatttacattttacagtgcaattttactgagttttgtgtgtgagcgctgggttaaggttactgtgaggatggcacgcaaggttgatgatgaatacgatttcttgttcaaagtggtgttgattggagattcaggagtcgggaagtcgaatcttctttccagatttactcgaaatgaattctgcctggagtccaaatctaccatcggtgtggagtttgcaactcgaacaatccaggtagatggcaagacaatcaaggcacagatatgggatacagctggccaagagaggtatcgggcaatcacaagtgcttattacagaggtgctgtgggagctttgttggtgtatgatattacaaagaatgctacttttgataatgtgaagcggtggctccgagaattgagagaccatgcagattcaaacatcgttatcatgttggttggcaataaatgtgacctgaaccatctgagagctgtgccaatagatgaggcacaggattttgctgaaaaagagggcctttccttcatggaaacatccgcattggagtctacaaatgtggagaaagcttttcagtcaattctcgctgaaatctatcagattgtgaaaaggaaatctcttgcagcagaagaggcagcctcttctgggcctagtcagggaactccaattaatgtcactgatgctgaagcagttgcaaaaaagagaagttgctgcctttaagtttatatgtgttccatgtaatctagacattttaagtccatccaagttgtctaggattaattgctgtttagccaaatatatgttctccgaatttccttgtgtgctttggtttgtggtaacttctaacattggtgagattatttttatgtactttgagtgtctgactagagaagcatcatcgctagaattaaggaggatgccttgtaagctctgaaagttat

SEQ ID NO: 187 - DNA, 1392 bp, Pinus radiata
gcaacattaaaacctccggcacaggtgcctctgttcagtgaagttctgttgcattctgttcgcagtgaagaaaaatgaacgcggggcctctcatagcagctctaagggactgcccattgctggcatttccctcatggaccgcggccggaattattttggcatatttttgttatatggctttagctcaatttatccttcccggaaagcagattcctggggtcgtgcttgctgataagacgaggatttactatcgctgtaatggttttatcactctttttctgctggttactcttttaggaatcagtatggcagcagggatcttgtcactagcagtggtggcagacaaaggtggggagctactttctacaacactgatattaagtgctttgatttcattattcttatatgttgctggtcacttatcccaaagcaaaatgacttctttaaaaccacatattacggggaactttattcatgattggtggtttgggatacaattaaatccacaattcttgggcattgacctcaaattccttctcattcgttctgggatgattggttgggccgtcataaatctatcagttgcagcaaaggccttccaactgaaggattcattaaacctttcaatgatcctttatcagatattttgtttgttatatgtgatggattacttctggtatgaagaatatatgacatccacttgggacataattgcggagaatcttggtttcatgttggtctttggggacttggtttggattccattcactttcagtattcagggttggtggcttttaacacacaaacctgaccttacaaaagctgctgccatccttgatgttctaatctttataattgggtatgacagtctacgaggctcaaataaacagaagcatattttcaaaaaagatccaacagcttgtatatggggtgagcctccgaaggttatcggggggaaattgctagcttcaggttattggggcatatccagacactgtaattatcttggtgacttacttctagccttctcttttagtttgccttgtggagctagctctttcgttccttacttttatcctatgtatctgctgttcctactactttggagagagcgaagagatgaggcaaaatgtcgcgaaaaatacaaggaagattgggttacatactgcaaacttgtaccgtggagaataataccatacttgtattagttgtctccgactttgaatttttcgttattcaatgcatgttttctccttacaggaattgcgagcctctcgagtctttggagaaattttcatctttatgggcattgttctctagactgtggggttccgacctgggtaactcacagtggagattgaaatgtgtatgtaaattttgtcttttatctat

SEQ ID NO: 188 - DNA, 3001 bp, Pinus radiata
ctcaatgatcagacaacaatctcatccagccgttctcacatcaaatcttgcgaactcggaaattagcgttcaatatacattgagtaaaagcagatactagatgatactttaaacgctcggtcccgagttcgatcactgtcgggtcacgcaaccaactgccagaagaatgcagaggccgtcgaagacgtctgtgggctatgcgattccggacgaggttttgaagtgcgtgatggggtacctggaggagccgtgcgatcgcagtgcggtttccctggtctgcaagaggtggaaccgtgtggatgcgctcactcgcaagcacgttaccattgcgttctgttacaccataagcccctcggatctcggtgcacggttccccgagcttgagtcgctgaaattgaagggaaagcccagggcttccatgtttaatttgattccccaggactggggcggatacgcggagccgtggattaatgagatttcccagacgttgctctgcttaaaggctcttcatttgcgcagaatgatcgttacggatgaggatctcagggctttggctcgcgcccgcggccacattctgcaggttcttaaactggagaagtgctcggggttttcgactctcgggcttctcgaagtcgcacggtcctgcagatctcttagggtcttgtttttagaggaaagtactattgaagatgaaggtggagaatggttacatgagcttgctcttcataattcttcattggaagttttgaacttctacatgacaggtttggaaaatgttaatgttaatgaccttgagatgatagcaacaaactgtcgatctctgacctcattcaagataagtgaatgtgatattctggatttaagaaatgtattcaagaaggccacagcattggaagagtttggcggtgggtcatttagtagcagtgaagagcaggctgtagaaccaaatatttatgaaatggttaaattccctacaaatttgatgtcattgtcaggactgaattacatgagtgagactgaattaccagttgtatttccacgagcatcttcactaaagaaactggatttgcagtatacacttttgagcacagaaaactattgccagttgttacagtcgtgcattaatattgaaattcttgaggttacgaatgcgattggagatagagggttagaagtagcagctgagaattgtaaaaaattaaggcgacttagagtggagcgtggggaagatgaagctggtttggagggtcagcaaaactttgtttctcacaaagggctttcagttatagctcaaggctgtcccaatctagagtacattgctgtgtatgtttcagatatgactaactcagccttagaatctgttggtaaattttgcaaaaatctgagggattttcggctagtcttgctagacaagaaagaacaagtgactgacctcccactagacaatggtgtcatggctctgctgcttgggtgccaaaagttgaagaggtttggattttacctaaggcctggaggattgacggacataggccttggttacattggaaagtttagtagcaatgtgaggtggatgcttctgggttatgtcggagagactgactttgggcttcttgagttctcgaagggatgcccaaatttggagaaacttgaattaaggggttgttgcttcagcgaatatgcattatctgtggcagcgcttagcttgaggtctctaaaatatatctgggttcagggctacaatgcaacgccatctggatttgatcttctagctatggagcgccctttctggaacatagagtttactccagcttctcaagtgacagtggatggttttaatttggaagaagaaattacagagaagccagcacagatattggcttattattcgcttgcaggaagacgaacagaccatccagattcagtaattcctttaagcttatcctcatggaatcgtcagctccagcatgtatatgaatattctcttttccatgcatatgaatattaagttgctgtgttatagttattattggtgtggatctatgtacattttaaccttctaaggagtggagcgtataaatggttatggtgtcagttatacttcctcggcatgccttttgaaaactataaaggcaagaagaattagccacgcatggcccttgtgcctgtcttccgcctgcaagcatggattttatgctgactgcttcaacgttatatggagatggattccttaatctgtcgcatttaagaggaaagccctgctttgtcaaatcttatgcctgctgtctgtatattacgcagaggatttgtccatctataacatgatcgtcgatcgtcactactttaccacagaaatgaatgcaggcaactccttgaggagcttctagatctattctttcttgaggctatcacattctagaagaaaatggtggcttactcgaagctgaggactcagaatgtatttatgcttgagattacatcatattaacatgtaagtttattggaatctgaaaattcctgatgtatccatttgtgggactttcggtcagtacaaaaagactcaacatatgccaaggattcctgatttgatttgaggtagagaagggttcggagttctcatttgagattatggcaagttagaaaatcagaaggatgattaaaagctgaagattccttgcatttagaattgggatcagacttctaaagctaagcctggtctatctgtatttctcatttcaccattgcgaggtttgcatctttaaatcatggatttctttcaataatttgtagctttctcgtgctaacaagacaaatttctgcctagtgtggagagttcaaagcctacagtttgatttctttttcttttcgctaaagaaaattgattcgcataaagacaaaggacatactgctactatgtttgtagaatccacaattatttgtacatattcaatgtgttttatatagcttaatacaagtagtctgtacgtatcctgtaaaaaaaaaa

SEQ ID NO: 189 - DNA, 1816 bp, Pinus radiata
ggttgcagcatgcttctcgattcgatgatgagatagtgatatatgattacccatattttacttggagtgcagacgcatgccatgctggcatgctctgtggacaacgtcgagatttaagatacaccactggagaagatctcggggatgactacaaagatcggtggttaagacctcacatagataaaggatggagtaacggccattccgcagattggaacccgcgattctgctattcattcttcttctcctcgacttaaatcttcgcagatttgatagatattcatttgcccgaacgttgctagggccctgaccatcaatggcgaagttatatcttttcgttgcggctttgcttctactttctgcttcatcagctgcttcccagtcgttgaatacctccagtgatgcgatcccggggaaagatttcagcacaggcaaacaaagtgtcgagtacttgcgattgtttgcggaagatatcagctggtccaacaacctggtgcttgggctgctagtgccccgaagcatttggtcgcctctgcctagggttttgcagacatggcttcgtaactatattgctggaactgttgtgtattttgtatccggaagcctttggtccttttatatttattactggaagcgcaatgtctacatcccggcagatagtacaccttcaaaggaaccaatcttcttgcaaataatggtgactatgaaagccatgcctttgtattgtgctcttcctacgctgtcagaatacatgattgagaatggttggacaaggtgttatgccgctataaatgaagttgggtggccttcttatattttattaactattctatacttactgctggtcgagtttgggatttactggatgcacagagagttacatgacataaaggttctatataagtatctccatgcaactcatcacatatacaacaaacagaatacactatctccttttgcaggattggctttcaatccactggatggcatattacaggcgattccccatgttattgctttatttatcataccaacacattttttaacccatgagctgcttctattttgtgagggaatctggacaaccaacattcatgattgcatacatggtaaagtttggcctattatgggagctgggtatcatactatccatcacacaacatatcgacacaattatggccattatacaatttggatggactggatgtttggaacacttcgtgatccaacagctgaagcaaagagcgtgaaaaatatgtgatttccagcttttctatgcagccgtttctcaaaagatcttttaactggttgtgctgtttactcgccaaagaaacttttttctacatttagggccatagaataattttttttgtatattccgtgtaggcagatgttgtacttctcgaagtttatttatttgggagcaatcggctttttatgtgtaagttgtaatttgtgatatcaagctctggtttaatgttgtaaagacttggtgagacgggctgtggaattatttttatcaacataattaggtgtactttcatatttcattttaaatcttggctcaaattattgtgaaggcatttcggttctgctttctttgtaacatttgtaataggcgaagtctgtctgctttttcgatgtatttgaacttaattctgtacaatagaacataacacatgtttgccatgtgtttaagatttccgcatgtataccggcactattaacatatgcaagtattcattgagggtttttaccactatagttggcattgcttttaatgtcggacaaagtccctaattatttaaaaaaaaaa

SEQ ID NO: 190 - DNA, 1322 bp, Pinus radiata
gctttctactgcttccttggaatgtcttctttcggcttttttccatggtagcagtcgtgcctatcagttgaaccttctcttccttaccttttctttcttctaacttcttccatgtaattctttctttggcttttatccatgctatcagttgtggctatcaggagtagctcggttaccttctgaaatttgcttcttgaactggtgaagatatatgaacgcatgcattcaatttgctagagataaaacgtggccaatttctctatatttcaacgttttgggattgtcggcattgtcgtaatggcttataaaacggaggaggactacgattatttgtttaaagttgtgctaatcggagactcaggggttgggaagtccaatttactttcgagatttactcgaaatgagttcagtttggagtccaaatcaacaataggtgtggagtttgcggcacgcagcgtcaacgtggacgggaaaagtatcaaagcccaaatctgggatacagctggtcaagaaaggtacagggccatcacaagtgcatattaccgtggagctgtgggcgccctgctggtgtatgacattactcgccatgtgacatttgagaatgttgagaggtggtataaagagctcaaggatcatacagatgtcaacattgtggtgatgctagtgggaaacaagtctgatttactgcatctgagagctgtttctgttgaagaagggaaatcgtttgcggagagggagagcctctacttcatggaaacatctgcattggactcaacaaatgtggagaactccttcacacaggtgttaacgcagatttacagaatagtgagtaaaaggagcttggatactgcagaggaagctttatcaacactgccaggcaagggtcagtcaatttctgtaaatggcaaggatgagttcactaccaagaaggctggatgctgctagttctacccattgaatgcattttctttttctcccctcgtcaatatttttgttaatcaggtgccatatgttattcttgtaatgttcaatttgattccatatgttactcttgtaatgctcaatttgatttgattccagttgacttgttcgaaaacgtccatttttcaaacttccatcagtctccaaaggattgatgtatggccatgcattcgctatagcatagtgaagctgggtttatactcagaagtgtagaatctttggtgtcgtatagacgaaccattttgcacattttgagattgttgtaatttctatacgtagtacgtttttgagattttgtgtgttataaagccacatgttatgctttccaaaaaaaaaaaaaa

SEQ ID NO: 191 - DNA, 1144 bp, Pinus radiata
ccttctcaaccacaaccatcatcccctcgcactctccacatcatctccagtccccatttcctgtttctattcttctatattaactatgcctgaaactcgtgaagattccgtctacctcgccaagctcgctgagcaggctgagcgttatgaagagatggttgagaacatgaagcgtgtggcttcttctgaccaagaactcactgtcgaggaacgcaatctgctgtctgtcgcgtacaagaacgttattggtgctcgccgcgcgtcctggagaatcgtttcatcaattgagcagaaggaggaatctaaaggcaatgaggctcaggtgtcaatgatcaaaggatacagggagaaaattgagagtgaactcgccaaaatctgcgaagatattctcgatgtcctcgataagcacctcattccctcagctgcctctggggagtccaaggtcttctaccacaagatgatgggcgactaccaccgctacctcgcagaatttgccaccggtgataagcggaaagatagcgccgacaagtccctcgaagcctacaaggccgcatcggaggttgccgtcaccgaattaccacctacacatcccattcgtcttggtctcgcactgaatttctcggtattctactatgaaattctcaatagtcccgaccgtgcatgccacctggccaaacaagcgttcgacgatgctattgccgagcttgatacgctctcggaggaaagctacaaggattccactctcatcatgcaattgcttagggataacttgacgctctggacttcggacatgcaagactctgccgataagcccgccgactcgaaggatgagcccgctgagacacctgcagaggattagatgtttccgtatgcatttattgtctcggaagtcttgttatttctaggcttttgttcttcaaattttaatcaatcatttgttgaatttgtcgttcgtctgtttgcgctctcattatatctctgcatttgtgtcatcctccattcctctcatcacgtccatgtgtccccttcccttattactccctatcccttcccctccagtattatgctcgaaatggtttcttatactccttaccttcaatgatgatagaggcggttcgagagcaaaaaaaaaaaaaaaaaaaaa

SEQ ID NO: 192 - DNA, 1508 bp, Pinus radiata
cccactcccgctcaatccgacaacttgttttgatagtccatgtcacgtgcgggctgtgttttcctgagcgacccaattctccctacaagtcccgcccacgactatctttgctttcaacgaccccccttcgacgccaacattactcgaacttgctagaataccctctttccaacatctatcacaatcttccacaatagaaatcatggcaaacgaacgcgagagcaaaaccttcctcgcccggctgtgcgaacaggctgagcgctacgatgagatggtcacatacatgaaggaagtcgcaaagatcggcggtgaattgaccgtggacgagcgcaaccttctctcagtcgcatacaagaacgtagttggcacacgacgtgcgtcgtggcgcatcatctcctcgatcgagcagaaagaggagtcaaaaggcaccgataagcacgtcggcaccatccgcgattaccgtcagaagatcgagacggagctcgagaaggtgtgccaggatgtcctcgacgttcttgatgagagcttgattcccaaagccgagactggcgagtctaaagtattttaccacaagatgaagggcgactaccaccgctatctcgccgagtttgcctcgggagagaagcgcaagaatgctgcgaccgccgcccatgaggcctacaagagcgccaccgatgttgcgcagactgagctcactcccactcaccccatccgcctcggtctggccctgaacttttctgtgttctactacgagatcctcaactcacccgaccgcgcttgccatcttgcaaagcaggcattcgacgacgccattgccgagctcgactctttgtctgaggagtcttaccgggacagcaccctcatcatgcagcttctgcgtgataatctcaccctctggacatcttctgatggtgctgaaccagctgagactggtgaggcaccaaagaccgaagaggccaagccagctgagactgccgaagccgcacccgccgagcccgagagcaagccagccaaggaggaggagcccgccgccccagctgcagcttaaattatcagctgacatggacaatgcatgctgttgcgaaccgattgaagcttggtccatcatgcctcgagactgcccaatctatgttctcgagactcagtcgcaatggacatttcttcagttcttcgggtttatgcaggttaacgggttgatgcggtgttctgcttcttatcatcatgcgaaaactggttcattatagcaagcgggtttacgagttctcacacgtgtcatgtcttatgggccccttcttcccttatctctccgatcctcctttgctttcctgctttatagccccggtatacttttgttttgtgcaatctttctggtgggatacgctggtggatggatgttttggcagttgtaaagtgagtaggtcttctatggacttactcgcaagcagctcgaccgtgatatctgggtataactaactagctataaattgatcatattcaatttgaaaaaa

SEQ ID NO: 193 - DNA, 1664 bp, Pinus radiata
gtagataatcactaccttctatttgcagacacctatttctgtgcatcgtgcctttaccctatccagggtttccaaatatttataaattgtgtctcccaggtttcggataaattccagttccactgcctcctacgaatccggaatcttcatcagttgccatggacgctcttctgaagcaatttgaaagacttcagagaccaattgatctggtgcagacgctacatgaaacccaagtgaagcaagtccctgcacgctacatccttccttcggaacagagaccatctcgtcctcttcaagtccagcagtctcttcctgtcattgatcttgcaggtctggaagatactgatcaacgcatcaagattgtcagtcaaatagcccaagcatctcaggaatggggtttctttcagataataaatcatgacatacctgtgtcattgctagagactgtgaagcgtgtttcacaggagttctttgatcttcctcttgaagagagacggaaacagtgtcctgtcaggcctggtgttcacatgcttgaaggctatggccggttctttgacatctctgatgacacggtcctggactgggttgataccctagttcattatatttctccagagtgggccaaagcagttgagcactggcccaaaaacccctccacatacagagaaacatatgaaaaatacggtgaagaggtaatgaaggttatggagaagttgctgggtcttctttcccagggtttggggctggacccaaagtatatccaaaccctcaataaggaatccctgctacaagtcagaatcaattattaccctccttgccctcagccagatatggtgaatgggtttaaaccccattcagatgtcgatatgctcactgttctgctggatgatggggtggacggtctccaggttcggaaagatgaggattggttcactgtgccctctattcctggagctcttattatcaacatcggggatttgttacagatagtaagcaatgggaaatacaagagtgccgagcaccgggcagtagcgaatacaaagcagagtcgcatgtctatggtcatgtttttgagaccacaagaggatgtgttgattgatactgctcccgaactgatcgatgaagctcatcccagcttgtacaaagccgttaaagctggggagtacgaaactgagtataatagcaaggattttcgaggaaaagacgctgtacatactttacgtatagaacaggcgtaggaagtcaatgtctagtccttcaattgcatttttataagatgtctatctagagaactattcaaggtatttgagtggaaactataactataagatagctgtaggtgttttgagtaaaagatgtaatttgctagcatattatatatgcaaaataaacataggggtatttcattgttttgagtgggtgtttcagtgccacgtgtttgggcattttgagtgggtatttcattgttttgagtgggtgtttcattgtcacttggttgtgtgcgttttgagtggaagatgtaatttagaggtataatattttgtttggaagtccctacttattagatttttggaaatttggttaaatattgatttgtcttgtttaaattggttttttgatatatggatttagcaagcttaaaactttttgcgacaaaaaaaaaa

SEQ ID NO: 194 - DNA, 1461 bp, Pinus radiata
ctcgcgttcaattctgcaagtgggccatttgaattttccacagaaacataaccctagattggtttggaaggtcgagttcgattctccaggtctgtatgctttcctatatgtttttagccttatccttaagatcatttttcgggtctcagaaagaggttgattggttataataaccagaataaatgatggagtctctgcgaaaactggtgtattatgcttgtgtttcgagaggcccagtaattgttgccgaatacaatgatttaggggacgcggagcaactggcaatagctgttgagtgcttaggtagagcccctccattccacagcagattcacacacactattaaaaacagaagatacagttttctcatggattctgagtttgtatattatgcaatagttgacgaggcccttccgaaagtgaaagttttttctttcttagagcaggtgagggatgagttcaagagactgctcagggccaagggtttgtcaaatagtaaggacgaaatcctgcagggttgtggcctgggtgatgattttgcctccacatttagacgcttggttgccccactcgttgggatcccccaaaccgaaaagcgcaggatggaggaagaagaagcaagtgcccgccggcaagaggatgagaccgagaccgaggtttgctcccccactgcttcggcaccactgtatgggaaaccccaacctgattccaaacctaaaaaggataaaaagtctctctgctctataccgcctttaattttgaagacaaacaaacacgaaaagaagaaggtgagggatcaagtgactcaggtaagagagatcatcatggagagcagtggcaaggcattggataacggtcagaagctcgaggttacggtggatggaaatactggaggtgctgcagccctttctttgcagaggactgctagtatgagaactaaaggtcagcagattgcacagagaatgtggtggcgcaatgttagggttgttctccttttggatttcgttgtttgcacaatactgtttgttgtgtggctctgcatctgtcgtggttttaaatgcgtttcagactgatggagtacgtctcttggataaaccttttcaagatgtgtagctgttttccttttaagctccaatcggccgcttttcaactgcaatctagtgaatcgaataatatgactcttaaatatatactgtaaatatagatttgtggtggcacgaagaggcttcgaataatgtgaccttcatgttttgggttcaggaggccactgtattagtattgctgttggttagccagtgtttcagagtgtaatagatacaaatgggctattgtatgggtcctgggaagatataggagaatttggtttgattcttgtacattcttcagatgccatataacattaaagggtgcattcgtttgatcaatgaaggaaaactggtgttgaaacacggaaaaaaaaaa

SEQ ID NO: 195 - DNA, 1225 bp, Pinus radiata
gcaaaacactccccccgcccgccccccccgcccgcaactcgctccgcccggctttttctctctcgctcgctcgctcgcgattcttttgctcttccgcaaatccctagtcgagagttaggtttcgtaacagtacacggaagatgtcgccctctgattcttcacgggaggaatatgtgtacatggccaagttagctgaacaggctgagcggtacgaggagatggtggatttcatggagaaagttgccaagactgtggacgtcgaggagctaaccgttgaggaacgtaaccttttgtctgtggcgtacaagaatgtgattggggccaggagggcatcgtggaggatcatttcttccattgagcagaaggaagagagcaggggtaacaccgatcatgtctcgatcattaaggactacaggggaaagatcgagtccgagctcagcaagatctgtgaaggcattctcagccttcttgagtcgcatctcattccttcagcctcctctgctgagtccaaggtgttttaccttaaaatgaaaggtgattaccacaggtatctggcagagtttaagactgcgactgaaaggaaagaagctgccgagagcactttattggcctacaaatctgctcaggatattgctggggccgaactggcttctactcacccaattaggctgggacttgcgctgaacttctctgttttctactatgaaatacttaactctcctgatcgggcttgcgctcttgcaaagcaggcatttgatgaggccatagctgagttggatacgctgggcgaggaatcatacaaggacagtacattgatcatgcaacttcttcgagataacttgactctgtggacttctgatcttacggatgaagctggggatgacattaaggaagcttcgaaactggagtctggagaggggcagcaatgatttgctaggatgatgtcagtactttaatgatattttgcaccgtcgtagatgccttgtggtttgtcacagtgaagattatttatgaactgagagtgctataagttgtttctctagtgttccttgatgagattcgggttggtctttagagtgttctaatggatattactatctcaaattgtcggttcccgtgtgcgctctttcgtgctgcctagtttaaattgcacggacccgttgcatgtgattatagatttctttctttatcagttaatgctaagacagttcaaggaaaaaaaaaa

SEQ ID NO: 196 - DNA, 915 bp, Pinus radiata
gatcgtccatagtgtgaccaggatcaagcgctctacatatcgtgcaactatcacaatcaggtcacaacaatgacggaaggatcaaactacgacttcttgttcaaggttgtactcatcggagactctggcgtcgggaaatcaaacttgctctcgcggtttaccaggaatgaattcaacctggactccaagtctaccatcggagtcgagttcgctactagatctgttcaagtagattccaagacagtcaaagcccagatctgggatacggcgggtcaggagcgataccgtgctatcacttcagcctactaccgaggtgctgtcggggctcttctcgtatacgacattgccaagcaccccacataccagaatgtgcaccggtggttgaaggagctccgtgatcacgcagactccaacattgtcatcatgcttgtcgggaacaagagcgatctcaagcatttgcgagctgtccctacagacgaggcgaaagcctttgctaccgagaacaacttgtcgttcatcgagacgtcggcattggacgcttccaacgtcgaggccgcttttcagaatatcctgtctgatatctaccacatcgtagcaaagaagaacctcgagaactcgagcgatgtgattcagccgttggaaggccgcggcatcgatatcgcaaagtcggaggatgatggcggtgccaaacagggcggcaaatgctgctaaagcgagtctcaccccagggttcttgatttatgtgatcggctcgatttatgcggcgtcacttgattgcgcgcagcctgtcggatgtgattctcgtctacatcccgaatccgactatctatcacgctttcctttcttttgtcaccattcttgtatgacttgtaaacagtacgcagattcgatatcctattcggcataaaaaaaaaa

SEQ ID NO: 197 - DNA, 3001 bp, Pinus radiata; identical to SEQ ID NO: 188

SEQ ID NO: 198 - protein, 253 aa, Eucaluptus grandis
MEREREQQVYQARLAEQAERYDEMVESMKQVAKLDVELTVEERNVLSVGYKNVIGARRASWRILSSIEQKEGTKGNEQNVKRIKDYRQRVEDELAKICSDILSVIDKHLIPSSSSGESTVFYYKMKGDYCRYLAEFKAGDDRKEAADQSLKAYEAASSTASTDLAPTHPIRLGLALNFSVFYYEIMNSPERACHLAKQAFDEAIAELDSLNEDSYKDSTLIMQLLRDNLTLWTTDLPEEGGEQSKVDEPAAES

SEQ ID NO: 199 - protein, 262 aa, Eucaluptus grandis
MSPSDSSREEYVYMAKLAEQAERYEEMVDFMEKVAKTVDVEELTVEERNLLSVAYKNVIGARRASWRIISSIEQKEESRGNTDHVSIIKDYRGKIESELSKICEGILSLLESHLIPSASSAESKVFYLKMKGDYHRYLAEFKTATERKEAAESTLLAYKSAQDIAGAELASTHPIRLGLALNFSVFYYEILNSPDRACALAKQAFDEAIAELDTLGEESYKDSTLIMQLLRDNLTLWTSDLTDEAGDDIKEASKLESGEGQQ

SEQ ID NO: 200 - protein, 264 aa, Eucaluptus grandis
MAAADSSREENVYMAKLAEQAERYEEMVEFMEKVAKTVDVEELTVEERNLLSVAYKNVIGARRASWRIISSIEQKEESRGNEDHVVIIKEYRGKIETELSKICDGILNLLESHLVPSASSAESKVFYLKMKGDYHRYLAEFKAGTERKEAAESTLLAYKSAQDIALAELAPTHPIRLGLALNFSVFYYEILNSPDRACSLAKQAFDEAISELDTLGEESYKDSTLIMQLLRDNLTLWTSDVTDEAGDEIKESSKRESGEGQPPQ

SEQ ID NO: 201 - protein, 262 aa, Eucaluptus grandis
MASTKERDGYVYVAKLAEQAERYDEMVEAMKNVAKLDVELTVEERNLLSVGYKNVIGARRASWRILSSIEQKEDSKGNEHNVKKIKEFRQKVEAELANICGDVMKVIDEHLIPSCAGGESTVFFYKMKGDYYRYLAEFKAGDDRKEAADQSMKAYELASTTAEADLSPTHPIRLGLALNFSVFYYEIMNSPERACHLAKQAFDEAISELDTLSEESYKDSTLIMQLLRDNLTLWTSDIPEDGAEDAQKLDNAAKAAGGEDAE

SEQ ID NO: 202 - protein, 505 aa, Eucaluptus grandis
MAEHRSYGNVNLKTFDAHVPEIKFTKLFIDGEFVDSVKGRTFETKDPRNGQVVARVAEGDEEDVELAVIAARRAFDHGPWPRMPGYQRGRIMSKFADLIEENIDELAALDTIDAGKLFSVGKARDIPNAAMLLRYYAGAVDKIHGEVLKMSRELHGYTLREPVGVIGHIIPWNFPTGVFFMKVAPTLAAGCTMIVKPAEQTPLSALFYAHLAKKAGVPDGVINVVTGFGPTAGAAISSHMDIDMVSFTGSTKVGHMVMQAAATSNLKQVSLELGGKSPLIVFDDVDLDTATNLALTGILYNKGEVCVAGSRVYVQEAIYEEFEKKLVAKAKAWPVGDPFDPNVRQGPQVDKKQFEKILSYIEHGKREGATLLIGGERLGTEGYYIQPTIFTDVNEDNVIVKDEIFGPVMSLMKFKTMEEVIKRANDTRYGLAAGILTKNIDLANTVSRSIRAGMIWINCYLAVDNDCPYGGYKMSGFGKDLGLDALHKYLHVKSIVTPIYNSPWL

SEQ ID NO: 203 - protein, 505 aa, Eucaluptus grandis
MAENQSDANGSLKTYDEHVPDIKFTKLFINGEFVDSVKGRTFETIDPRNGEVTARVAEGDKEDVDLAVKAARQAFDHGPWPRMPGYQRGRIMSKFADLIEENIDELAALDTIDAGKIFSMGKAVDIPHAATCLRYYAGAADKIHGEVLKMSRELHGYTLLEPVGVVGHIIPWNFPTSMFFMKVAPALAAGCTMIVKPAEQTPLSALYYAHLAKKAGVPNGVINVVTGFGPTAGAAITSHMDIDMVNFTGSTKVGRIVMQTAATSNLKQVSLELGGKSPIMIFDDADLDTATDLALIGIVHNKGEICVAGSRVYVQEGIYEEFEKKLVAKAKAWPVGDPFDPKVQQGPQVDKKQFEKILSYIEHGKREGATLLTGGERLGTKGYYVQPTIFTNVKEDNVIVKDEIFGPVMSLMKFKTVEEAIKRANDTRYGLAAGIVTKNIDVANTVSRSIRAGVIWINCYFAFDNDCPCGGYKTSGFGRDLGLDALHKCLHVKSIVTPLYNSPWL

SEQ ID NO: 204 - protein, 510 aa, Eucaluptus grandis
MREREMAENQSNANGSLKTYDAHVPEIKFTKLFINGKFVDSVKGRTLETIDPRNGQATARVAEGDKEDVDLAVKAARQAFDHGPWPRMPGYQRGRIMSKFADLIEENIDELAALDTIDAGKLFSVGKAQDIPHAATMLRYYAGAADKIHGEVLKMSRELHGYTLREPVGVIAHIIPWNFPTAVFFMKVAPALAAGCTMIVKPAEQTPLSALFYAHLAKKAGIPDGVINIVTGFGRTAGAAISNHMDIDMVSFTGSTEVGRIVMQAAATSNLKQVSLELGGKSPLIIFDDVDLDTATDLALTGILHNKGEICVAGSRVYVQEGIYEEFKNKLVAKAKAWPVGDPFDPNVRHGPQVDKKQFEKILAYIEHGKREGATLLTGGERLGTEGYYIQPTIFTNVKEDNMIVKDEIFGPIMSLMKFKTTEEVIKRANDTRYGLAAGVLTKNIDMANTVSRSIRAGTIWINCYFAFDNDCPLGGYKMSGFGRDFGLDALHKYLQVKSVVTPIYKSPWL

SEQ ID NO: 205 - protein, 207 aa, Eucaluptus grandis
MASRRRMLLKVIILGDSGVGKTSLMNQYVNRKFSNQYKATIGADFLTKEVQFEDRLFTLQIWDTAGQERFQSLGVAFYRGADCCVLVYDVNVMKSFDNLNNWREEFLLQASPSDPENFPFVVLGNKIDVDGGNSRVVSEKKAKAWCASKGNIPYFETSAKEGFNVEAAFECIAKNALKNEPEEEIYLPDTIDVTGGGRQQRSTGCEC

SEQ ID NO: 206 - protein, 250 aa, Eucaluptus grandis
MAVPENLGRDQYVYLAKLAEQAERYEEMVEFMHKLVVGWTPAAELTVEERNLLSVAYKNVIGSLRAAWRIVSSIEQKEEGRKNEDHVVLVKEYRSKVENELSDVCASILRLLDTNLVPSAAASESKVFYLKMKGDYHRYLAEFKVGDERKAAAEDTMLAYKAAQDIAQADLASTHPIRLGLALNFSVFYYEILNQSDKACSMAKQAFEEAIAELDTLGEESYKDSTLIMQLLRDNFTLWTSDVQDQLDEP

SEQ ID NO: 207 - protein, 262 aa, Eucaluptus grandis
MATAPSAREENVYMAKLAEQAERYEEMVEFMEKVAAAAAAADAEELTIEERNLLSVAYKNVIGARRASWRIISSIEQKEESRGNEDHVAAIRDYRSKIESELSGICAGILKLLDSRLIPAAASGDSKVFYLKMKGDYHRYLAEFKTGAERKEAAESTLTAYKAAQDIANTELAPTHPIRLGLALNFSVFYYEILNSPDRACSLAKQAFDEAIAELDTLGEESYKDSTLIMQLLRDNLTLWTSDMQEDGADEIKEAPKADEQQ

SEQ ID NO: 208 - protein, 263 aa, Eucaluptus grandis
MAAAAPPPSSPREEYVYMAKLAEQAERYEEMVEFMEKVSAAAADAEELTVEERNLLSVAYKNVIGARRASWRIISSIEQKEESRGNEDHVAAIRDYRAKIEAELSKICDGILGLLDTRLIPAASVGDSKVFYLKMKGDYHRYLAEFKTGTERKEAAESTLTAYKAAQDIANSELAPTHPIRLGLALNFSVFYYEILNSPDRACGLAKQAFDEAIAELDTLGEESYKDSTLIMQLLRDNLTLWTSDMQDDGVDEIKETAKADEQ

SEQ ID NO: 209 - protein, 356 aa, Eucaluptus grandis
MKKGGLNPILNLKLSLPPPDEDSIAKFLTQSGTFVDGDLLVNRDGVRVVQQTEVEVPPLIKPTDNQLSLADIDTIKVIGKGNGGIVQLVQHKWTGQFFALKVIQMKVEESARKQIAQELKINQSSQCPYVVVCYQSFYDNGTVSIILEYMDGGSLADFLRKVKTIPEPNLAVICKQVLKGLLYLHHEKHIIHRDLKPSNLLINHRGEVKITDFGVSAIMASTSGQANTFVGTYNYMSPERIIGNNYGYKSDIWSLGLVLLECATGKFPYTPPDQQEGWTNFYELMEAIVDHPPPSAASDQFSSEFCSFISACVQQDPKKRWSANELMGHPFISMYEDLNVDLASYFTNAGSPLATF

SEQ ID NO: 210 - protein, 215 aa, Eucaluptus grandis
MEDDERGEEYLFKIVLIGDSAVGKSNLLSRFALDEFDINTKATIGVEFQTQVVEIDGKEVKAQIWDTAGQERFRAVTSAYYRGAVGALIVYDITRRTTFESVKRWLDELDTHCDTAVARMLVGNKCDLNNIREVSTEEGKALAEAEGLFFMETSALDSTNVQISFEIVIREIYKNISRKVLNSDSYKAELSVNRVTLAKNGADSSGRSFYSCCAR

SEQ ID NO: 211 - protein, 218 aa, Eucaluptus grandis
MSSSDEEGGEEYLFKIVIIGDSAVGKSNLLSRYARNEFNPHSKATIGVEFQTQSMDIDGKEVKAQIWDTAGQERFRAVTSAYYRGAVGALVVYDITRRSTFDSVSRWLDELKTHSDTTVARMLVGNKCDLESIRDVTVEEGKSLAESEGLFFMETSALDATNVKTAFEIVIKEIYNNVSRKVLNSDAYKAELSVNRVTLAGNGADGSKRSQSFSCCSR

SEQ ID NO: 212 - protein, 354 aa, Eucaluptus grandis
MALVPSDPINNGQSLPLIAEVNMSSDSSSAAAVVRATVVQASTVFYDTPATLDKAERLLAEAASYGSQLVVFPEAFVGGYPRGSTFGVSIGNRTAKGKEEFRKYHASAIDVPGPEVDRLAAMAGKYKVFLVMGVIERDGYTLYCTILFFDPQGHYLGKHRKVMPTALERVIWGFGDGSTIPVFDTPIGKIGAAICWENRMPLLRTAMYAKGVEIYCAPTADARDIWQASMTHIALEGGCFVLSANQFCRRKDYPPPPEYVFAGTDDDLNPDSVVCAGGSVIISPSGNVLAGPNYDGEALISADLDLGEIARAKFDFDVVGHYSRPEVLSLIVRDHPSNPVTFASTSGKPEGPYK

SEQ ID NO: 213 - protein, 580 aa, Eucaluptus grandis
MDPSKSRDSAESTRVIQFPNDVLERILSLIDSHRDRNAVSLVSKAWYNAERWTRRHVFIGNCYAVSPQIVARRFPNIRSVMLKGKPRFSDFNLVPPNWGADVHGWLAVFADQYPQLEELRLKRMTVTDESLKFLARKFHNFRVLSLLSCDGFSTDGLEAIATDCRHLTELDIQENGIDDISGNWLSCFPENFTSMEVLNFASLSSDVNFDALERLVSQCKSLKILKVNKSITLEQLQRLLVRAPQLTELGTGSFLQELTAHQSEELERAFIGCKYLHALSGLWEATTLYLPVLYPACTNLTFLNLSYAALQSEELAKLVAHCPRLQRLWVLDTVEDVGLEAVASSCPLLEELRVFPADPYDQDINRGVTESGFLAVSLGCRKLHYVLYFCRQMTNAAVARIVQNCPGFTHFRLCIMKPGQPDYLTNEPMDEGFGAVVKTCTNLRRLGVSGLLTDLTFEYIGRYAKNLETLSVAFAGGSDLGMKSILVGCPKLRKLEIRDCPFGNEALLSGLEKYESMRSLWMSACKVTLHGCKTLATQRPRLNVEVMKDEEIDDGQSYKVYVYRTVAGPRTDAPSFVHTL

SEQ ID NO: 214 - protein, 745 aa, Eucaluptus grandis
MESCNCVEPQWPADELLMKYQYLSDFFIALAYFSIPLELIYFVKKSAVFPYRWVLVQFGAFIVLCGATHLINLWTFAIHSRTVAYVMTIAKVLTAAVSCITALMLVHIIPDLLSVKTRELFLKNKAAELDREMGLIRTQEETGRHVRMLTHEIRSTLDRHTILKTTLIELGRTLGLEECALWMPTRSGLELQLSYTLRQQQNPVGYTVPIHLPVINRVFSSNRALKISPNSPVARIRPLAGKYIPGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPMHAIIALSSLLQETELTPEQRLMVETIMKSSNLLATLINDVLDLSRLEDGSFQLNIATFNLHAVFREVLNLIKPVASVKKLLITLNLAPDLPEYAVGDEKRLMQVILNVVGNAVKFSKEGGISITAFVAKAEYLREARTPEFLPLPSDNHFYLRVQVRDSGSGVNPQDIPKLFTKFAHNQSLATRNSGGSGLGLAICKRFVTLMDGHIWIESEGIGKGCTATFIVRLGIPEKLNESKFPVLPRGSSNHVLANFSGLKVLVMDDNGVGRAATKGLLLHLGCDVTTVSSGDELLHAVSQEHKVVLMDICTPGIDSYEVAVQIHRLYSQHHERPLLVAITGSTDKVTKENCMRVGMDGVIQKPVSLDKMRNVLSELLECGHQMSSLARV

SEQ ID NO: 215 - protein, 206 aa, Eucaluptus grandis
MASRRRMLLKVIILGDSGVGKTSLMNQYVNRKFSNQYKATIGADFLTKEVQFGDRLFTLQIWDTAGQERFQSLGVAFYRGADCCVLVYDVNVMKSFDNLNHWREEFLIQASPSDPENFPFVVLGNKIDIDGGNSRVVSEKKAKAWCASKGNISYFETSAKEGFNVEAAFQCIAKNALKNEPEEELYLPDTIDVAGGQQQRSSGCEC

SEQ ID NO: 216 - protein, 218 aa, Eucaluptus grandis
MAGGYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSNIVIMLVGNKADLRHLRAVSTEDAKAFAERENTYFMETSALESMNVENSFTEVLTQIYHVVSRKALDVGEDPAAPPKGQTISVGSKDDVSAVKKVGCCSA

SEQ ID NO: 217 - protein, 216 aa, Eucaluptus grandis
MVDSFDEECDYLFKAVLTGDSAVGKSNLLSRFARKEFQLDSKPTIGVEFAYRNVKVADKLIKAQIWDTAGQERFRAITSSYYRGALGALLVYDITRRVTFENVKKWLRELRDFGNPDMVVVLVGNKSDLGSSREVDLEEGKDFAEAENLCFMETSALENLNVEEAFLEMITRIHEITSQKSLEAKNNEITSSLHGPKQVIQIDEVTATKKPYCCSS

SEQ ID NO: 218 - protein, 218 aa, Eucaluptus grandis
MAGYKADEEYDYLFKLVLIGDSGVGKSNLLSRFTRNEFNLESKSTIGVEFATKSLSIDGKVVKAQIWDTAGQERYRAITSAYYRGAVGALLVYDVTRRATFENVARWLRELRDHTDPNIVVMLIGNKSDLRHLVAVPLEDGKSFAEMSHYYFMQTSALDATNVEAAFAEVLSQIYRIVSKRAVEAGDNPSVSCVPGQGQTINVKEEGSVFKRIGCCSS

SEQ ID NO: 219 - protein, 225 aa, Eucaluptus grandis
MASGGGYGDGNQKIDYVFKVVLIGDSAVGKSQILSRFARNEFSLDSKATIGVEFQTRTLVIQHKSVKAQIWDTAGQERYRAVTSAYYRGAVGAMLVYDITRRQSFDHIPRWLEELRSHADKNIVIILVGNKTDLENQRAVPTEDAKEFAQKEGLFFLETSALDSTNVESAFLTVLTEIFNIVNKKSLVAGESQTNGNPASLAGKKIIIPGPAQEIPAKNKMCCGT

SEQ ID NO: 220 - protein, 373 aa, Eucaluptus grandis
MADAAAQNGQFSDFPAVPTHGGQFIQYNIFGNHFEITAKYRPPIMPIGRGAYGIVCSVLNSETNEMVAIKKIANAFDNHMDAKRTLREIKLLRHLDHENVIGIRDVIPPPLRREFTDVYIAMELMDTDLHQIIRSNQGLSEEHCQYFLYQILRGLKYIHSANVIHRDLKPSNLLLNANCDLKIIDFGLARPTAENEFMTEYVVTRWYRAPELLLNSSDYTAAIDVWSVGCIFMELMNRKPLFPGRDHVHQMRLLVELLGTPADADLGFVRNEDARRYIRQLPQHPRQPLASVFPHVHPLAIDLVEKMLTFDPTKRITVEEALAHPYLTRLHDIADEPVCRQPFSFEFEQQPLGEEQMKDMIYQEAIALNPEFA

SEQ ID NO: 221 - protein, 372 aa, Eucaluptus grandis
MATLVEPPNGVHSEGKHYYSMWQTLFEIDTKYVPIKPIGRGAYGIVCSSVNRETNEKVAIKKIHNAFENRVDALRTLREIKLLRHLRHENVIGLKDVMMPIQRKSFKDVYLVYELMDTDLHQIIKSSQTLTNDHCQYFLFQLLRGLKYLHSANILHRDLKPGNLLINANCDLKICDFGLARASNGKGQFMTEYVVTRWYRAPELLLCCDNYGTSIDVWSVGCIFAELLGRKPLFPGTECLNQLKLIINVLGSQREEDIEFIDNPKAKKFIKSVPYSPGTPLSRLYPNAHPLAIDLLQKMLIFDPSKRIGVTEALQHPYMSPLYDPNTNPPAQVPIDLDVNEDLEEEMIREMMWKEMLHYHPEVAVGNLEVYS

SEQ ID NO: 222 - protein, 572 aa, Eucaluptus grandis
MNYFPDEVIDHVFDFVTSNRDRNVISLVCKSWYRIERLSRQRVFIGNCYAISPERLIARFPGVRSLTLKGKPHFADFNLVPPDWGGFVYPWIDALARSKVNLEELRLKRMVVTDDGLELISRSFVNFKSLVLVSCEGFTTDGLAAIAANCRFLRELDLQENEVEDHRGQWLNCFPDSCTSLVSLNFACLKGDINLAALERLVARSPYLKSLRLSRAVPLDTLQKILVRAPQLVDLGVGSFVHDPDSETYNKLVTAIEKCKSMRSLSGFLEVSAYCLPAIYPICSGLTSLNLSYAPGIPGSELTKLIRHCRKLQRLWILDCIGDKGLGVVASSCKELQELRVFPSDPYGVGNAAVTEEGLVAISRGCPKLNSLLYFCQQMTNAALKIVAQNCPNFIRFRLCILEPTKPDSSTNQPLDEGFGAIVQSCKGVRRLSLSGLLTDQVFNYIGTFAEQLEMLSIAFAGDNDKGMLYVLNGCKKIRKLEIRDCPFGNIALLTDVGKYETMRSLWMSSCDITLGGCKTLAKKMPRLNVEIINENNEMEDCIDDEQKVERMYLYRTLVGPRKDAPEHVWTL

SEQ ID NO: 223 - protein, 628 aa, Eucaluptus grandis
MKRDHRDACSGGYGGGGGGEASGASKGEPPSSSSTHSLPGSGKAKMVMWGEDDQDPSGGGGGGMDELLAVLGYKVRSSDMAEVAQKLEQLEMVMGSAQEDGISHLSYDAVHYNPSDLSSWVQSMLFELNPPPPPQQVADAVLAAAESSSTIAQHHRSHLGSRSQTQTRTLSQTSAPTQTQSQVIFNDDSEYDLRAIPGVAAFPQGDSDFESAARKKMKTLNGGSNSLSSSSSSSAAGAAPSESTRPVVLVDTQETGVRLVHTLMACAEAVQQENLKLADALVKHIGLLAASQNGAMRKVATYFAEALARRIYRIYPNDGSLDSSCNDILQMHFYETCPYLKFAHFTANQAILEAFATASRVHVIDFGLKQGMQWPALMQALALRPGGPPAFRLTGIGPPQPNNTDALQQVGWKLAQLADTIGVEFEFRGFVANSLADLEPAMLDIRPPEVETVAVNSVFELHPLLARPGAIDKVLSSIKAMRPKIVTMVEQEANHNGPGFVDRFTEALHYYSSLFDSLEGSGVAPPNQDLVMSEVYLGRQICNVVACEGPDRVERHETLVQWQARMGSAGFDPVHLGSNAFKQASMLLALFAGGEGYRVEENDGCLMLGWHTRPLIATSAWQLAAATQ

SEQ ID NO: 224 - protein, 643 aa, Eucaluptus grandis
MSKVLRFTGGEDFYSGRSIYQSPKEVNLFLSLGNHVDVYFPPSKRSRISAPFVFSEDLFEQKRQDTIEVLPDECLFEIFRRLPGGQERSACACVSKRWLNLLSNICPNERSSGKSQNNLDPTCGGEEVSSEDDGFLSRSLEGKKATDIRLAAIAVGTADRGGLGKLSIRGSKLSHVTSLGLGAIARSCPSLKALSLWHLPSVGDEGLLEVANGCHQLEKLDLCQCPNITNKFLVAVARNCPNLTDISIESCSSIGNEGLAAVGQFCQNLKSISIKNCPSVGDQGIVGLISRAGSALTKFKLQALNITDVSLAVIGHYATAVTDLTLASLHNVTERGFWVMGNGHGLQRLRSLIVTACRGATDLGLESLGKGCPNLKQLCIRSSAFLSDGGLVSFMKSARSLESLQLEECHRITLSGLYGLVVGCGDKLKSLALTNCWGFKDFDFGSPQVSPCKSLRSFSVRNCPGFGDACLVALGKICPHLQQVELSGLTGITDEGLLRLLECCEAGLVKVNLSGCINLTDQVVSAMAKLHGRTLEVLILDGCTKVSDLGLLAIAENCQLLSDLDVSKCAISDFGLMALARSSQLSLQVLSVSGCSLVSDKCLPALKKVGRTLLGLNLQHCTAISTRSVDLLLEELWRCDILA

SEQ ID NO: 225 - protein, 523 aa, Eucaluptus grandis
MGESRRGEMDGTTRGGSNADMYLPNYKLGKTLGIGSFGKVKIAEHVLTGHKVAIKILNRRKIKNMEMEEKVRREIKILRLFMHPHIIRLYEVIETPTDIYVVMEYVKSGELFDYIVEKGRLQENEARNFFQQIISGVEYCHRNMVVHRDLKPENLLLDSKWNVKIADFGLSNIMRDGHFLKTSCGSPNYAAPEVISGKLYAGPEVDVWSCGVILYALLCGTLPFDDENIPNLFKKIKGGMYTLPSHLSAGSKDLIPRMLIVNPMKRITIPEIRQHPWFQAHLPRYLAVPPPDTMQQAKKIDEEILQEVVNMGFERNQLVESLRNRIQNEATVAYYLLLDNRFRPSNGYLGDEFQETMECTFNRGNPGELTIPTVGPRYPLPGYMDYQGVNSKPGYYGAEKKWALGLQSRAHPREIMTEVLKALRELNVCWKKIGHYNMKCMWNPCVPSHESMVSNPVQSNYFGDESTIIENDGATKSRNVVKFEVQLYKTTEEKYLLDLQRVQGPQFLFLDLCAAFLAQLRVL

SEQ ID NO: 226 - protein, 218 aa, Eucaluptus grandis
MAGYRAEDDYDYLFKIVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLVGNKSDLRHLLAVSTEDGKSFAEREALVFMETSALEATNVENAFAEVLTQIYNIVSKKALETSEQANGSAVPSQGEKIDVGKDVSAVKRGGCCSS

SEQ ID NO: 227 - protein, 258 aa, Eucaluptus grandis
MDSSRESLVYVAKLAEQAERYEEMVDEMKKVAKLNVALTVEERNLLSVGYKNVIGARRASWRILTSIEQKEDARGNEISVKRIKEYRKKVESELSSICSDIMVILDEHVIPSASDGESKVFYYKMKGDYYRYLAEFKSDDEKKEVAEQSMKAYEMATSIAESDLPYTHPIRLGLALNFSVFYYEILNSAERACHIAKQAFDDAIAELDNLNEESYKDSTLIMQLLRDNLTLWTSDITEEGEDAQRINGSAKVGMEEGE

SEQ ID NO: 228 - protein, 591 aa, Eucaluptus grandis
MEDRNVKRPDSPGLSDIVLTCVMPYIDDPKDRDAISLVCRRWYEIDALTRKHVTIALCYTTSPERLRRRFRHLESLKLKGKPRAAMFNLIPENWGGYVTPWVTEIAQSFDCLKSLHFRRMIVEDSNLEVLATSRGRVLQVLKLDKCSGFSTDGLLHVGRLCKTLRTFFLEESTIIEKDGAWLHELAMNNTVLETLNFYMTELSSFSVQDLQIIARNCRSLTSVKISDCEILDLVGFFQDAAALEEFGGGLFNEEPERYAALSFPARLCRLGLTYISENEMPIVFPIASRLRMLDLLYAFLSTDDLCLLIQQCPILEVLETRNVIGDRGLEVLAHSCKRLKRLRIERGADEQGMGDEGGLVSQRGLMDLARGCLELEYLAVYVSDITNSSLECIGTYSKNLCDFRLVLLDREEKITDLPLDNGVRAILRGCEKLRRFALYLRPGGLTDVGLGYIGQYSQNIRWMLLGYVGESDEGLREFSRGCPSLQKLEMRGCCFSEQALADAVMRLTSLRYVWVQGYRGSDTGRDILAMVRPFWNIELIPARRIAVANQNGENVLNEDPAHILAYYSLAGPRNDCPDSVIPLAPARLLTL

SEQ ID NO: 229 - protein, 216 aa, Eucaluptus grandis
MANRVDHEYDYLFKIVLIGDSGVGKSNILSRFTRNEFCLESKSTIGVEFATRTLQVEGKTVKAQIWDTAGQERYRAITSAYYRGAVGALLVYDITKRQTFDNVQRWLRELRDHADSNIVIMMAGNKSDLNHLRAVPGDDGQALAEKEGLSFLETSALDATNIEKAFQTILTEIYHIISKKALAAQEAAATTLPGQGTTINVADATGNANKRGCCST

SEQ ID NO: 230 - protein, 320 aa, Eucaluptus grandis
MESFPVINMENLNGEKRAITMDKIKDACENWGFFELVNHGIPPEFMDTIESMTKGHYKKCMEQRFGELVASKGLECVQTEVHDLDWESTFHLKHLPVSNISQIPDLDDDYRRVMKEFALKLEKLAEELMDLLCENLGLEKGYLKKAFYGSQGPNFGTKVSNYPPCPKPDLIKGLRAHTDAGGIILLFQDDKVSGLQLLKDGQWVDVPPMRHSIVVNLGDQIEVITNGKYKSILHRVVAQTDGNRMSIASFYNPGSDAVIYPAPALVESEAEEASKAVYPKFVFEDYMKLYAALKFQAKEPRFQAMKAMESSPSLGPIATA

SEQ ID NO: 231 - protein, 320 aa, Eucaluptus grandis
MESFPVINMENLNGEKRAITMDKIKDACENWGFFELVNHGIPPEFMDTVERMTKGHYRKCMDQRFRELVASKGLENVQTEVHDLDWESTFHLKHLPLSNISQVPDLEDDYRKVMKEFAVKLEKLAEELMDLLCENLGLEKGYLKKAFHGSNGPNFGTKVSNYPPCPKPELIKGLRAHTDAGGVILLFQDDKVSGLQLLKDGQWVDVPPMRHSIVVNLGDQIEVITNGKYKSVLHRVVAQTDGNRMSIASFYNPGSDAAIYPAPALMESKAEEASKAAYPKFVFEDYMKLYAALKFQAKEPRFQAMKVMESSPNLEPIATA

SEQ ID NO: 232 - protein, 376 aa, Eucaluptus grandis
MSGGSDLPEEILIQILLKLPVKSLVRFRCVSKSWDSLITHPSFVSLHLRHAMAGHDRSVILLRHYSLTQRKERNTLYLDGESFLEHQELEFPLKTHDTYYLAGSCNGLLCFSDYIINNLQVILWNPSLRKCVQLPIPRFIDTDLTHTYVLGFGFDTRRVDYKVVRLIYILGKNWSVIVPPEVEIYELKTNAWRGIQTAVPYVIPESSSQAFVNGAIHWIGYNPADRRLKVASSPRSIVVLFDMQDEVFGEMELPKGGDYANRLNLSLAVHQDLICLLHCHPMEEDGHQLYGVCWVWVMKEYGAADSWTKLFTINISEHGGIGRILGFRKKGDALLVTHNDELVSYDLRGQRISRLGLYGVARSFEVIPYMDCLILV

SEQ ID NO: 233 - protein, 200 aa, Eucaluptus grandis
MGCSSSLPDRASGRLGGLNSENGAVNDAKNLRVKLVLLGDSGVGKSCIVLRFVRGQFDPTSKVTIGASFLSQTIALQDSTTVKFEIWDTAGQERYAALAPLYYRGAAVAVVVYDITSPESFQKAQYWVKELQKHGSPDMVMALVGNKADLQENREVTVQDGIDYAEKNGMFFIETSAKTADNINQLFEEIAKRLPRPTPS

SEQ ID NO: 234 - protein, 396 aa, Eucaluptus grandis
MDGGAPQPADTVMSEAAPAQQQQQQPQQAQPQGIENIPATLSHGGRFIQYNIFGNIFEVTAKYKPPIMPIGKGAYGIVCSALNSETNEHVAIKKIANAFDNKIDAKRTLREIKLLRHMDHENVVAIRDIIPPPQREVFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTAAIDVWSVGCIFMELMDRKPLFPGRDHVQQLRLLMELIGTPSEAELGFLNENAKKYIRQLPLYRRQSFTEKFPHVHPLAIDLVEKMLTFDPRLRLTVEEALAHPYLNSLHDISDEPTCMNPFNFDFEQHALTEEQMRELIYREALAFNPEYLQ

SEQ ID NO: 235 - protein, 375 aa, Eucaluptus grandis
MESSSSGGASAEHSVRGIPTHGGRYVQYNVYGNLFEVSRKYVPPIRPIGRGAYGLVCAAMNSETNEEVAIKKIGNAFDNRIDAKRTLREIKLLCHMDHENVIGLKDIIRPPSRENFNDVYIVYELMDTDLHQIIRSNQPLTDDHCRYFLYQLLRGLKYVHSASVLHRDLKPSNLFLNSNCDLKIGDFGLARTTSETDFMTEYVVTRWYRAPELLLNCSEYTAAIDIWSVGCILGEIMTRQPLFPGKDYVHQLRLITELIGSPDDSSLGFLRSDNARRYVRQLPQYPRQQFSSRFQTMSPGAVDLLERMLVFDPIRRITVEEALCHPYLAPLHDINEEPICPTPFIYDFEQPSFTEENIKELIWRETLRFNPDPMH

SEQ ID NO: 236 - protein, 534 aa, Eucaluptus grandis
MGQVPSSASSSPEPSHRGGAISSSHRLDSLPSLEFVSSFEDEEDAAAADEGAAAGYDYTGDLPDECLAHVFHFLGTGDRKRCSVVCRRWRRVDGESRHRLSLNAQADLLSSLPSVFSRFDAVTKLALRCDRKSVSLGDEALVLISLRCRGLARLKLRGCREVTDLGVAAFAENCRQLRKLSCGSCSFGARAINAVLDHCVNLEELSIKRLRGIHDGAEPIGPGAAAKSLRSICLKELINGQCFGPLLVGARKLSTLKLIRCLGDWDNVLQTIGSSNPGLLEVHLERIQVSDGGLCGIANCKGIDSLHVVKVPECSNLGLSSIAENCRQLRKLHIDGWRINRIGDEGLVEVAKQCLQLQELVLIGVSVTHSSLAAIGSNCRKLERLAFCGSDTVGDAEIACIAAKCEALKKLCIKNCPITDVGIESLAQGCPNLVKIKVRKCRGVSGQVVELLKERRGSLVFNLDACGIEALDDIRGVQESVMEFPPVNTSDAPSSSNERSMLFRAKLGLFAGRNLVACTFRRWSNGEHSTNGNL

SEQ ID NO: 237 - protein, 581 aa, Eucaluptus grandis
MAYSFPEEVLEHVFSFIGSDRDRNAVSLVCKSWYEIERWCRRRVFVGNCYAVSPAAVVRRFPEVRSVELKGKPHFADFNLVPEGWGGYVSPWITTLARAYPWLEEIRLKRMVVTDESLELIARSFKNFKVLVLSSCEGFSTDGLAAVAANCRNLRELDLRESEVEDMSGHWLSHFPDSYTSLVSLNISCLGSEVSFSALERLVSRCPDLRSLRLNRTVPLDRLANLLRRPPQLAELGTGVYSAELRSDDFSNLVGALAGCRELRSLSGFWDVVPAYLPAVYPLCSGLTSLNLSYATIQSSELTKLISQCHSLQRLWVLDYIEDSGLEALAACCKDLRELRVFPSEPFNREGNVSLTEQGLVSVSEGCSKLQSVLYFCRQMSNAALLTIARNRPNMTRFRLCIIEPRCPDYITHEPLDTGFGAIVQHCKDLQRLSLSGLLTDRVFEYIGTYAKKLEMLSVAFAGDSDLGLHHVLSGCDSLRKLEIRDCPFGDKALLANAAKLETMRSLWMSSCSVSFGACKLLGQKMPRLNVEVIDERGHPDSRPESCPVEKLYIYRTVAGPRFDMPDFVWTMDEDSALRPS

SEQ ID NO: 238 - protein, 152 aa, Eucaluptus grandis
MAQYEEDNAEFYVRYYVGHKGKFGHEFLEFEFRPDGKLRYANNSNYKNDIMIRKEVWLTPAVLRECRRIISESEIMKEDDSNWPEPDRVGRQELEIVMGNEHISFTTSKIGSLVDVQTSKDPDGLRIFYYLVQDLKCFVFSLISLHFKIKPI

SEQ ID NO: 239 - protein, 215 aa, Eucaluptus grandis
MARRAEEEYDYLFKVVLIGDSGVGKSNLLSRFTRNEFCLESKSTIGVEFATRTLQVEGRTVKAQIWDTAGQERYRAITSAYYRGALGALLVYDVTKPTTFDNVSRWLKELRDHADSNIVIMLIGNKTDLKHLRAVATEDAQSYAEKEGLSFIETSALEATNVEKAFQTILSEIYRIISKKPLSSEDAAPANIKEGKTIVVGESEANTKKACCSSS

SEQ ID NO: 240 - protein, 385 aa, Eucaluptus grandis
MAVDCLTSKTSPAMPPQHKDEAREDKKHLVFDASVIRHQPDIPKQFIWPDEEKPCANAPDLAVPLIDLDGFLSKDPSASEEASRLVGDACQKHGFFLVVNHGVDAGLISDAHKYMDKFFGLPLSEKQRAQRKLGEHCGYASSFTGRFSSKLPWKETLSFGYSAEKSSANVVEDYFKNTMGEEFEQSGRVYQDYCEAMSRLSLGIMELLGMSLGIGRDHFREFFESNDSIMRLNYYPPCQKPDLTLGTGPHCDPTSLTILHQDQVGGLQVFVDNEWRSISPNFNAFVVNIGDTFMALSNGLYKSCLHRAVVNSRTPRKSLAFFLCPRSDKVVRPPSELVAMSCPRAYPDFTWPVLLEFTQKHYRADMNTLRAFTNWLQQRTSEPVR

SEQ ID NO: 241 - protein, 207 aa, Eucaluptus grandis
MASRRRMLLKVIILGDSGVGKTSLMNQYVNRKFSNQYKATIGADFLTKEVQFEDRLFTLQIWDTAGQERFQSLGVAFYRGADCCVLVYDVNVMKSFDNLNNWREEFLIQAGPSDPENFPFVVLGNKVDVDNGNSRVVSEKKARAWCASKGNIPYFETSAKEGFNVEAAFECIAKNALKNEPEEEIYLPDTIDVAGGARQQRSTGCEC

SEQ ID NO: 242 - protein, 267 aa, Eucaluptus grandis
MLTISDEKLFHNCLLALYLIGPPTFISLRYIQAPYGKHHRSGWGPTISPALAWFLMESPTLWLTLLIFPFGKNSSNARSLILISPFLFHYFHRTIIYPLRIRSSGGQRSTQPNAANRFPVTVAFMAFGFNLLNAYVQARWVSNYESDGAAGGWWFWGRFLVGLVIFVSGMYMNMSSDMVLVGLKREGKGYRVPRGGLFEFVSCPNYFGEIVEWLGWAVMTWSWAGFGFFLYTCANLVPRARANHRWYLDKFGEEYPKSRKAVIPFLY

SEQ ID NO: 243 - protein, 434 aa, Eucaluptus grandis
MAEAKTVHSPLVTYFSMLSLLTLCPPFVILLWYTMVHADGSIVQTFDYLRQHGLQGFLDIWPRPTAVAWKIIAVYAAFEAALQLLLPGKTVKGPISPAGNQPVYKANGMAAYFVTLITYLGLWWFGIFNPTVVYDHLGEIYSALIVGSFIFCIFLYIKGHVAPSSTDSGSSGNIIIDFYWGMELYPRIGKDFDIKVFTNCRFGMMSWAVLALTYCIKQYEQNGKVADSMLVNTILMLVYVTKFFWWEAGYWNTMDIAHDRAGFYICWGCLVWVPSIYTSPGMYLVNHPVNLGTQLALYILVAGILCIYINYDCDRQRQEFRRTNGKCSVWGKAPSKISASYTTTSGENKTSLLLTSGWWGLSRHFHYVPEILGAFFWTVPALFNHFLPYFYVIFLTILLFDRAKRDDDRCRSKYGKYWKLYCEKVRYRIIPGIY

SEQ ID NO: 244 - protein, 355 aa, Eucaluptus grandis
MRSTKPLKPLKLAVPAPDAPIASFLTASGTFHDGDLLLNHKGLRLKSEEKESCLSNGKELDLDFSLEDLETIKVIGKGSGGVVQLVRHKWVGKLFALKVIQMNIQEEIRKQIVQELKINQASQCPHVVICYHSFYHNGAFSLVLEYMDRGSLADVIRQVKTILEPYLAVVCKQVLQGLVYLHNERHVIHRDIKPSNLLVNHRGEVKITDFGVSAMLASSMGQRDTFVGTYNYMSPERISGSTYDYSSDIWSLGMVVLECAIGRFPYMQSEDQQSWPSFYELLEAIVESPPPSAPADQFSPEFCSFVSSCIQKDPQQRSSSLDLLSHAFIKKFEDKDIDLGILVGSLEPPVSFPRC

SEQ ID NO: 245 - protein, 541 aa, Eucaluptus grandis
MDSTTHSFQRRPLSIKLWPPSQSTRIMLVERMTKNLIAPSVLSRKYGLLSKEEAEEDAKRIEESAFAIANQHMEKEPDGDGSSAVQVYATQSSKLMLEVIKRGPRMKVDGEAILPAKAIAASETVFDISGGRRAFIDAEEAEELLKPLKAPGNFYKKICFSNRSFGLDAARVAEPFLVSVKDKLTDVDLSDFVAGRPEAEALEVMNIFSSALEGCNLRSLDLSNNALGEKGVRAFGALLKSQNNLEELYLMNDGISEEAALAVCELLPSTEKLRILHFHNNMTGDEGALAISEIVKHSPVLEDFRCSSTRVGSDGGVSLCDALSACSRIKKLDLRDNMFGVESGVALSKAIPSFADLTEVYFSYLNLEDEGTEALAIALKESAPSLEVLEMAGNDITAKAGAVLAACIAAKQFLTKLNLSENELKDEGAILIGKALEEGHGQLVEVDLSTNSIRRVGARVLAQAVVQKPGFKMLNINANFISEEGLDEVKDIFKTSPNMLGPLDENDPEGEDFDEEADEEGAGHEDELEAKLKDLEIKHEE

SEQ ID NO: 246 - protein, 218 aa, Eucaluptus grandis
MVKLTMIARVTDGLPLAEGLDDGRDVKDAEFYKQQVKALFKNLSKGQNEPSRMSVETGPYYFHYIIEGRVCYLTMCDRSYPKKLAFQYLEDLKNEFGRVNGAQIETAARPYAFIKFDTFIQKTKKLYQDTRTQRNISKLNDELYEVHQIMTRNVQEVLGVGEKLDQVSEMSSRLTSESRIYADKARDLNRQALIRKWAPVAIVLGVVFLLFWVKSKIW

SEQ ID NO: 247 - protein, 486 aa, Eucaluptus grandis
MSYVSSNRKPLLSRKATNDGHAEKSPYFDGWKAYDKDPFHPTQNPSGVIQMGLAEHQLCFDLVQEWLVSNPEASICTKKGVDKFRDIALFQDYHGLPAFRNAVAKFMGRVRGDKVKFDPDRIVMSGGATGAHEMITFCLADPGDAFLVPTPYYAGFDRDLCWRTEARLLPVVCHSSNNFKVTRKALEEAYAKAVEANISVKGLLLTNPSNPLGTILDRDTLREAMSFINEKNIHLICDEIYAATVFRQPDFISIAEIIEEDQEYNRNLVHIIYSLSKDMGFPGFRVGIVYSYNDAVVECGRRMSSFGLVSSQTQYLIASMLSDDQFIGKFLLESAERLETRHKNFTDGLHQVGIKCLNGNAGLFLWMDLRELLMESTVEAETALWRGIINEFKLNVSPGSSFHCSEPGWFRVCIANMNEETMKVALARIREFVRRNGDKLNRKEKCRQSDLRLRLSFRRMDDVLRSPCIMSPHSPIPQSPLVRTRT

SEQ ID NO: 248 - protein, 369 aa, Eucaluptus grandis
MATLVEPPDGVRQRGKQYYSMWRTLFEVDAKYVPIKPIGRGAYGVVCSSINRETHEKVAIKKIHNVFENRIDALRTLRELKLLRHIKHENVIALKDVMLPVHSASFREVYLVYELMDTDLHQLIKSPQPLSNEHCRFFIFQLLKGLKYLHSANVLHRDLKPGNLLVNANCDLKICDFGLARTNQGDGQFMTEYVVTRWYRAPELLLSCDNYGTSIDVWSVGCIFAEILGRKPLFPGTECLNQLRLIIDTLGSQGEEDIEFIDNRKARRYIKALPFSRGTHFSQLYPQADPLAVDLLQRMLVFDPRKRITVTEALQHPYMAGLYDPRGNPPAQYPINLDIDDSMEQHMIREMMWNEILHYHPHQYASLHG

SEQ ID NO: 249 - protein, 222 aa, Eucaluptus grandis
MGQQSLIYSFVARGPVLLAEYTEFSGNFTSVASQCLQKLPATSNKFTYNCDGHTFNYLVDDGLTYCVVAVESVGRQIPMAFLERIKEDFTHRYDAGKAATASANSLNREFGPKLKEHMQYCVDHPEEISKLAKVKAQVSEVKGVMMENIEKVLDRGEKIELLVDKTDNLRSQAQDFRQQGTKMRRKMWLQNMKIKLIVLGIIIALILVIVLSVCHGFNCGHK

SEQ ID NO: 250 - protein, 700 aa, Eucaluptus grandis
MADVAGLTEAAGSRFSSLELIGRGSFGDVYKAFDKELNKEVAIKVIDLEESEDEIEDIQKEISVLSQCRSPYITEYYGSYLHQTKLWIIMEYMAGGSVADLLQSGPPLDEMSIACILRDLLHAIEYLHTEGKIHRDIKAANILLSENGDVKVADFGVSAQLTRTISRRKTFVGTPFWMAPEVIQNSDGYNEKADIWSLGITAIEMAKGEPPLADLHPMRVLFIIPRENPPQLDEHFSRSIKEFVSLCLKKVPAERPSAKELLKHRFIRNARKSPRLLERIRERPKYPTVEDGETPMIGKGVVEGSDTVKIRRDIKGEETVRASNQGRGGKNTGWDFSIGGVQGTGTVRTNLLPPQVRERKSENSHNQATPRRVADGGNSWLSASGNSPQAAEISLRKDARDLHYNNHHDDEDSSLSGSGTVVVRTPRESQPSPLLRDQSTLSSSSYSSVEDASTTGTVVFRGQHDESDSPRTPKSRLGIQERSSSASLEDSAANLAEAKAAMQGAFKRGNAREKRSVLGKFNDGQENGNREQLTKSPDSSRNSYEYFDAHKVLPRSRQASDDEDIAKILSSSAPLSVLLIPSLKETTGDDSDGPVVHAVSTSLTNLERMKPGSCEVLISKLLQRLASSKESSLKDLQDLATHTFSKGKISPEKSGNANTEADNRKKQQNKEFNSNANLSPLARFLLSRWQGQVSRDLNPT

SEQ ID NO: 251 - protein, 237 aa, Eucaluptus grandis
MSQKGLIYSFVAKGTVVLAEHTQFSGNFSTIAVQCLQKLPSNSSKYTYSCDGHTFNFLTDSGFVFLVVADESVGRSVPFVFLERVKDDFMQHYSASIASGDPHPLADDDEDDDLFQDRFSIAYNLDREFGPRLKEHMQYCMSHPEEMSKLSKLKAQISEVKGIMVDNIEKVLDRGERIELLVDKTENLQFQADIFQRQGRQLRRKMWFQNLQMKVVVAGAVVIVIFLLWLIAKWGSK

SEQ ID NO: 252 - protein, 257 aa, Eucaluptus grandis
MEGEEEQKPAATKRRKPRSGAPSSAPINNLDDGCLMHIFSFLSPIPDRYNTALVCHRWCYLACHPRLWLRVDRSVKDSSEPGVFPNIELAVSAARPGDTILIAAGGSHVASNIQIKKPLCLIGGGELPDETMLLCSRGSDSALEFLSTCKLSNLTVKAELGCCLLHRSGRLIIDGCILQCETDPLDYLSCPIVSTATGSKVVSSPNGCHGDGVSVSRTRIEGGAKAVLTSGDLALQRVRVICARTSMFFWFDVECPS

SEQ ID NO: 253 - protein, 540 aa, Eucaluptus grandis
MGQSSSSTAPALGGRGADPDPDPDPDDGHSAAKSKAVIWPVLGEAAAEECAAPDLSLSISDLPDECLACVFQYLGSGDRARCSLVCRRWLAVEGQSRQRLALHAQSELLEAVPALFARFDSVSKLALKCDRKALSIGDDALVLISLKCRNLTRLKLRGCRALTDTGIAVFTSNCRGLRKLSCGSCAFGAKGLNAVIDHCASLEELSVKRLRSPTEGAAAEPIGPGAAAASLKTICLKELYNGQGFGPLIIGSKNLRTLKLVKCYGDWDTVLQVMVERVAKLVEIHLERIQVSDFGIASLSNCSDLEILHLLKTPHCTNLGLISVAERCTLLRKLHIDGLKLNRIGDDGLIAVAKRCPNLRELVLIGVNPTELSLDLLGSNCLTLERLAFCGSDTVGDAEIMCIAARCVALKKLCIKNCPVSDEGMKALASGCPNLVKLKVKKCGGVTSEGAAWLRMRRGSLALNLDSSDQEQIDAFASDGGGEENHVEFPPVPSQTAGANIASSSGTSRSSSFKSRLGSLRGKSLMACTFRRWSSGSKDS

SEQ ID NO: 254 - protein, 221 aa, Eucaluptus grandis
MGEESFIYSFVARGTMILAEYTEFTGNFPAIAAQCLQKLPSSNNKFTYSCDHHTFNFLLEDGYAYCVVAKESVAKQISIAFLERVKVDFKKRYGGGKADTAVAKSLNKEFGPIMKEHMKYIIEHAEEIDKLIKVKAQVSEVKSIMLENIDKAIDRGENLTILADKTENLRDQAQAYKKQGTQIRRKMWYQNMKIKLVVFGILLFLILVIWLSICHGFDCSN

SEQ ID NO: 255 - protein, 218 aa, Eucaluptus grandis
MAGGYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSNIVIMLVGNKADLRHLRAVSTEDATAFAEKENTFFMETSALESMNVENAFTEVLTQIHRVVSRKALEAGNDPGALPKGQTINVGSKDDVSEVKKVGCCSS

SEQ ID NO: 256 - protein, 392 aa, Eucaluptus grandis
MAELAGDLPGELVTEILDRLPVESLLRCRSVSKRWRGIIDSREFVRSHLARSFESTANLTLFFRHSSSLYCIDLTSLLRHGGVAEMNYPLMCYSDQIRVLGSCNGLLCISNAADDVVVWNPATRKHKFLPYSAVEVRRSSVFSVCVYGFGYDERRDDYVLLRLVQLVTEPIESEVSIYSLKDNAWRRLKDMPYSLVYPRKMGVFVCGHLHWIMTRELVSDSANLLVAFDFRIEDFKVVDQPEGIDNKLDMDLSVLGGCLCLSINGNHMGVHVWIMKEYGLRDSWTKLFSIPQSEVARPLGFVRPLAYASNGRQVLVRQDSKNLILYDLETKGMERVDINGMPNSFEAEICLRTLVSVDDYGGYTKKKQQEAEEIENRTKRDDFLSVGFKLVL

SEQ ID NO: 257 - protein, 275 aa, Eucaluptus grandis
MADTATRAIPPRMEFSDEAAAGGAAAPAAAAAAAEEEEEEEEAPSPAAEISEVEKSKIGIMRAVVERDDPSAKDVDDFMIRRFLRARDLDIEKASKLFLKYLSWRRSFVPNGVISASEVPNNLAQRKLFMQGLDKKGRPIIVVYGGRHNPSKGSLEEFKRMILLRMPGGQEKFMGIADLEGWGYKSSDIRGYLAALSILQDCYPERLGKLFLIHVPYIFMTAWKMVYPFIDPKTKKKIVFVDNKKLRTTLLGDIDESQLPDVYGGRLPLVAIQDS

SEQ ID NO: 258 - protein, 544 aa, Eucaluptus grandis
MAARLFSSLLSRSSSAASSSSSSSSARALLSRARKPLLGREIKSYSTAAAIEEPINPGVTVNHTQLFINGQYVDSASGKTFPTFDPRTGEVIAHVAEGEAEDINRAVAAARKAFDEGPWPRMTAYERANVLFRFADLLEKHNDEIAALETWDNGKPYEQAAKIELPMIVRQIRYYAGWADKIHGLTVPADGQYHVQTLHEPIGVAGQIIPWNFPLLMYAWKVGPALATGNTVVLKTAEQTPLSALYATKLLHEAGLPPGVLNVVSGFGPTAGAALSSHMDVDKLAFTGSTDTGKIVLELAAKSNLKPVTLELGGKSPFIVCEDADVDKAVELAHFALFFNQGQCCCAGSRTYVHESIYEEFVEKAKARATVRSVGDPFKSGIEQGPQIDSEQFQKILRYIRSGVEGGATLETGGERFGTKGHYIQPTVFSNVKDDMLIAKDEIFGPVQTILKFKDLKEVIQRANNSRYGLAAGVFTQNIDTANTLTRALKVGTVWVNCFDVFDAAIPFGGYKMSGHGREKGVYSLSNYLQVKAVVTSLKNPAWL

SEQ ID NO: 259 - protein, 370 aa, Eucaluptus grandis
MSSSSSSGGGGGGAKLPHDVAVEILKRLPARSLLRFRCVCRSWRSAIDDPRFVALHWSHSALHASSRHLACLDCGDDAVQNRCSLFPNAPLALPPPPSQIEIPFVAPPNRYALVGSCNGLICVSESSSDGTERALYFWNLFTRKHKAVRLPRPERMPPFSVGGAHVVLGFCFDAKSNDYRVVRIIRYLGIRRRRFRNKKPRVEVYSFRTDSWKTLECEVPLLCDSAVFLNGNLHWYSFNGEGDGYGSIVLFNVADEVFDEIALPEGISPHFVLSVTVLNESLAVFFSHREACFVWVMKDYGVPESWSKLYTFEVTEPVTGFDGFTWNGELLMEINCEERVSWNPITAQLSILPLSARYKLVPVVESLVPP

SEQ ID NO: 260 - protein, 542 aa, Eucaluptus grandis
MDAAPLTSQRRPFSVKLWPPSKNTRETLVERMTRNLTSESIFTRKYGSLSPEEAEENAKRIEDEAFTTANQHYEKEPDGDGGSAVQLYAKECSKLILEVLKKGPKGKDEKPPTSDSAKAPRETFFDISKGQRAFIEAEEAEELLRPLKEPENSFTKICFSNRSFGLGAAHVAEPILISLKQQLKEVDLSDFIAGRPETEALEVMSIFSAALEGSVLNSLNLSNNALGEKGVRAFSALLKSQSQLEELYLMNDGISEEAARAVCELIPSTEKLRVLHFHNNMTGDEGAIAIAEVVKCSSLMEDFRCSSTRIGSDGGVALSEALENCIHLKKLDLRDNMFGVDAGVALSKALSKHTNLTEVYLSYLNLEDEGAIAIANVLKETASSLTVLDMAGNDITAEAAPTLSACIAAKNLLTKLNLAENELKDEGAIQIGKALQEGHEQLTEVDLNTNSIRRAGARFLAQVVVQKPGFKLLNIDGNFISEDGIDEVKSIFKKSPEMLASLDENDPEGGDEDEEDEEGEAEGEADEGELESKLKNLEVGEE

SEQ ID NO: 261 - protein, 331 aa, Eucaluptus grandis
MALVRERRQLNLRLPLTDLPNRRPLFPPPLSLPLPPSAAAAASATAAAGSGAAATSLSDLESLGVLGHGNGGTVYKVRHRRTSAVYALKVVHAGCDATVRRQVLREMEILRRTDSPHVVRCHGIFEKPNGDIAILMENMDAGSLQTLLEASGTFSEKQLAAVARHVLNGLHYLHSLKIIHRDIKPSNLLVNSAMEVKIADFGVSKIMCRTLDACNSYVGTCAYMSPERFDPDSYGGNYDGYAGDIWSLGLTLLELYLGHFPLLGPGQRPDWATLMCAICFGEPPKSPDGSSEEFRSFVECCLQKESSKRWSVAELLNHPFIAGGKDPAGSL

SEQ ID NO: 262 - protein, 325 aa, Eucaluptus grandis
MVSAAQAAGGSLSLSLSLRDREILTSVNSVASSFSLLGSGFIVLCYLLFKELRKFSFKLVFYLALSDMLCSFFNIIGDPSIGFFCYAQGYTTHFFCVASFLWTTVIAFTLHRTVVRHKTDVEDLEAMFHLYVWGTSVVMTIIRSIGNDHRHLGAWCWSQTGRTGKAVHFITFYAPLWGAILYNGFSYFQVIRMLNNATRMAVGMSDRAYHLDARPDMKALNRWGYYPLILIGSWTFGTINRIHDFIEPGHKIFWLSLLDVGTAALMGLFNSIAYGLNSSVRRAIRERLDLVTWPETIRPWLPNSSRIRHQQQESELVSLKSQDPH

SEQ ID NO: 263 - protein, 517 aa, Eucaluptus grandis
MAGLSDDLITKILDRFPKESLIPFRCVSKQWRRLIDDRFFRKSLLYLVPMYSSSLYRIGLRRLGDLVEIENPFESEQIVLLGSCRGFLCIYNEIDGQIAIWNPSTRSCQLLPPADAEIAHRLGPPACVYGFGYDYWNDEFVLLRLVQTMEDPILSVSIYRSRGSVWRRLQGIPPYSLVEPRTMGVFLRGRLHWIMRRDPMQNSAIVLVAFDIHTENSVEVQQLNFIDNRLPMYLAILEGGLCLIINDERGGVSAWIASEYGSEESWARLFSIADYSMGRVLLQPLAYSQNGRQVLLLYRETLVWYDLDTGDVENINSMLSISNTPIVGDYLGSRRRRLQGAWRQLEGMSYSLGNACKRGIFLHGRLHWIMTLQLVLNSTKVLVAFDIRSDKFMEVSELNFIDNRLNMDLTLLGGCLCLIIYGEQRGVHAWIMREYGLNRPWYMLFSMPGHSRPLLAYSQNGRQVLVAVGGKTLVWYDRVWYDLHTGGVKKFGKRGMPSSYEAEIYLRTLVPVGKPPI

SEQ ID NO: 264 - protein, 219 aa, Eucaluptus grandis
MAGGEAFSSNPPPPKPAILGNNSKTINAKLVLLGDMGAGKSSLVLRFVKDQFFDFQESTIGAAFFSRTVGVNDASVKFEIWDTAGQERYHSLAPMYYRGAAAAIVVYDITSTESFERAKKWVEELHKQGNPNLIITLAGNKTDMEDKRKVAAEEACMYAEERRLVFIETSAKTATNVSKLFYEIAKRLPRVQAMQNSAPAGMVLADTSSEETRSASCCS

SEQ ID NO: 265 - protein, 307 aa, Eucaluptus grandis
MEIPMIDLSELDGKNRSKTMALLHHACEKWGCFKIKNHGVDPELMEKVKHFVNTHYEENLKASFYESETAKCLENANGATSDLDWECTFFIWHRPKSNIEDFPNLSNDLRKTMDEYIAQLVKLAENLSELMCENLGLGKDHIKRAFSGKDGPSVGTKVAKYPECPYPEKVRGLREHTDAGGIILLLQDDQVPGLEFLHDDQWVPIPPSTNDTIFVNTGDQLEVLSNGRYKSVWHRVMAVESGSRLSVATFYNPAGDAIISPAPKLLYPEKYTFGEYLKLYATTKFQEKEPRFESMKSVMSNGYNGVV

SEQ ID NO: 266 - protein, 336 aa, Eucaluptus grandis
MATVPQEAINELQALMDRVDEPLMRTFENIHQGYLKETLVRFLKAREGNVAKAHKMLLDCLKWRVQNEIDIILSKPIIPDDLYRAVRDSQLIGLSGYSKEGLPVYAIGVGLSTFDKASVHYYVQSHIQINEYRDRVILPSASKRYGRPITTCLKVLDMSGLRLSALSQIKLLTIISTVDDLNYPEKTNTYYIVNAPYVFSACWKVVKPLLQERTRKKVQVLPGCGRDDLLKIMDYSSLPHFCKGEGSGSGRHTSYGPENCYSLDHPFHQQLYSYIKEQSQRRQPIQPIKQGSFHVALPEAAAEGTEIAKTIESELQKFENGSGMPDSLDGLKINGE

SEQ ID NO: 267 - protein, 198 aa, Eucaluptus grandis
MARAGNKNIQAKLVLLGDMGAGKTSLVLRFVKGQFHEYQESTIGAAFFTQVLSLNEATVKFDIWDTAGQERYHSLAPMYYRGAAAAVVVYDLTSMDSFQRAKKWVLELQRQGNPKLIMFLVANKADLEQKRQVLSEEGEQYAKENGLSFLETSAKTAQNVNELFYEIAKRIAKATPSRPTGMKLQRQESRRSLFCCSG

SEQ ID NO: 268 - protein, 408 aa, Eucaluptus grandis
MSTLSEDDETEILLRLPVKSLLKFKSVCKPWNSLISSPYFAKTHLQISASSPRILLATNPPLSVSCESLHDDDRAGHEGTPLTQLRPPVEAPDGCRPRIVGYCDGLVCLEYDDHRIVVLWNPATGESRNIPNASCSYNRPTICGLGYDPSTDDYKILRHCSVADAYGFPEYSVFDVFALKTGSWRRVHDKHDEFNYWPEAGTYANGFLHWLVVGRDPWEHKKIVSFSMSKEKFEDALLALPEANEGTGFRVLGVAGECLLIYKSMAEVDTFMAWMMSDYGVRSSSSWMELCSVTLPNQTLNTYFYMRPLCSTRAGKIAFSSIGTTRLSMILRNVMTKWFVKEDKLDFVVYVESFVSPHGAKLQNQYVSRVKEPMERSDFIGDHSVFKEGETSYKKANSHLSSKRRKAS

SEQ ID NO: 269 - protein, 319 aa, Eucaluptus grandis
MEIFPVINLEKLNGEERGVTMEMIRDACENWGFFELVNHGISHELMDTVERLTKGHYKECMERKFKEMVASKGLEAVQSEIGDIDWESTFFLRHLPVSNISEVPDLKEDYRKVMREFALEIEKLAEQLLDLLCENLGLEKGYLKKVFYGSKGPTFGTKVSNYPPCPNPELFKGLRAHTDAGGIILLFQDDKVGGLQLLKDGKWIDVPPLRHSIVINLGDQLEVITNGKYKSVEHRVIAQSDGNRMSIASFYNPGSDAVICPAPALLKKEAGEEGQAYPKFVFEDYMKLYARLKFQAKEPRFEAMKATESTIARGPIATA

SEQ ID NO: 270 - protein, 337 aa, Eucaluptus grandis
MQVSQPARPSDPIYRRDDHLSQACKDLVSSLPSEEGWVATSFCLYQGFWFPTWLFNGVLACQNHFQAQPSDILLVTNPKSGTTWLKAILFALLNRAKYSDSDSKQRHPLLTQNPHDLVPFLEVKLYLQQENPDLTTFESPRLFATHLPYSSLPGSVRDSRCKLVYLCRNPKDMFISLWHYVNKRRAEEKGQIPLPKCLDKFCRGLSPYGPYWDHVMGYHKASLEMPEQVLFLMYEELKEDPRVHVSRLADFLGCPFSDEELRDGTVEGIMRMCSFDNLSSLEVNKSGKLWTGQENQWFFRRGKVGDWVNYLSAEMADKIDQVMEEKLRDSGLNFQYK

SEQ ID NO: 271 - protein, 584 aa, Eucaluptus grandis
MDPTKKPRESSSSTASAAAAEFPDEVLERVLALLASHKDRSAASLVSKAWYHAERWSRTRVFIGNCYSVTPEIVAGRFPKIRSVTLKGKPRFSDFNLVPQNWGADIRSWLTVFAERYPFLEELRLKRMTVTDESLKFLALKFPNFKALSLMSCDGFSTDGLAAIATRCRNLTELDIQENGIDDISGDWLSCFPENFTSLEVLNFASLNSDVDFDALERLVSRCNSLKVLKVNRTISLDQLQRLLVRAPRLTELGTGSFLQELNAHQYSELERAFGGCKTLHTLSGLYEAMAPYLPVLYPACANLTFLNLNDAALQNEELAKLVVHCPCLQRLWVLDTVGDEGLGAVARSCPLLEELRVFPANPFDEEVNHGVSESGFLAISYGCRRLHYVLYFCRQMTNAAVATIVQNCPDFTHFRLCIMNPGQPDYLTNEPMDEAFGAVVKRCTKLQRLAVSGLLTDQTFEYIGTYAKNLETLSVAFAGSSDRGMQCVLRGCPKLRKLEIRDCPFGNAALLSGLEKYESMRSLWMSACKVTMNGCAVLARERPRLNVEVMKDEESSDGQAYKVYVYRTVAGPRRDAPPFVLTL

SEQ ID NO: 272 - protein, 430 aa, Eucaluptus grandis
MSSSAVQFAAASRDGHENNGGGGGDSSGERLDPTAVLLPVDPGAPDLSLPRETFLRAALSLKDQVVQATWREGGAADPTAYTGLLGTAFLCLRSYAATGDRGDLLLSAEIVDACASAARASTRHVTFLCGKGGVFAVGAVVANLLGDHHKRDFFLNLFLEVAQERALPVGPEEGGFGMSYDLLYGRAGFLWAALFLNKNLGEETVPNNVLMPIVDAVLAGGRAGASDIATCPLMYRWHGTRYLGAANGLAGILQVLLHFPLCEEYLEDVKGTLRYIMSKRFPHSGNYPSSEGNPRDKLVQWSHGATGMAITLCKASQVFPHDRDFRDAAIEAGEVVWKNGLVKKVGLADGISGNAYAFLSLYRLTGERIYEDRARAFASFLYHDANKPVGTGHGHVADYAFSLYQGLAGAACLWFDLVDAENSRFPGYEL

SEQ ID NO: 273 - protein, 380 aa, Eucaluptus grandis
MQILPSPEESITCSGPHYDRAKEAKEFDETKAGVKGLIDSGMAKVPRLFIHPPQNLRDLSSDTEGSATDLKVPIIDMMGCQDSQLRRDVVDDLRRASETWGFFQIINHGIPVDVMDGVLEAVKQFHEQPEGVKGEWYSRDDARKFRYYSNGDLFWSKAATWKDTLLFDFPFGEPDREAVPLLFRETVFEYEKHVEKLKGSLSELLSEALGLDSGYLGDIECMDSKRIVSHYYPTCPEPELTLGTINHSDATYLTLLLQNHNGGLQVRHQNQWVDVSPVPGAILVIIGDFMQLVSNDKFKSVEHRVLARRAGPRVSVLCFLFPGETRKSKPYGPIKELLDENNPPMYRETSFTEYFGYYLSSGNGLNGESVLPHFRVSEPK

SEQ ID NO: 274 - protein, 766 aa, Eucaluptus grandis
MLKKLASGIFISSLLITVSVADNGFPRCNCDDEGSLWSVESILECQRVSDFLIAVAYFSIPIELLYFISCSNIPFKWVLFQFIAFIVLCGLTHLINGWTYAHHPFQLMVALTVFKILTALVSCATAITLITLIPLLLKVKVREFMLKKKAWDLGREVGIIMKQKEAGLHVRMLTQEIRKSLDRHTILDTTLVELSKTLGLQNCAVWMPNNGKTEMNLTHERGRNYSGTYHIPIPITDPDVVSIKQSDQVHILRPDSELATASSVGPGESGPVAAIRMPMLRVSNFKGGTPELHPACYAILVLVLPGGEPRSWSNQELEIIKVVADQVAVALSHAAILEESQLMREKLEEQNRALQQEKRNAMMASQARSSFQKVMNDGLKRPMHTISGLLSIMQDESLNADQKIIGNAMARTSAVLANLINDVVNMSTKNSGRFPLEVRSFSMHDMIREAACLAKCLCIYKGFSFELDIDRSLPNNVMGDERRVFQVILHMIGNLLNDSNQGKLVTLRILREKASGSQGRYDRGWVTWRSESTDRGVRIKFEVGISDDISLLERSVSTIQLGGRKYNSDGVEEDFSFSICKWLVQLMQGNIWVVPNTQGFAQSMTLVLRFPLRESISVTISEPGPSPDYTLSNSVFTGLKVLLVDSDDANKAVTRKLLEKLGCKVSTASSGFECLGALRPSESSFQIVLLDLHMPSLDGFEVANKIRQFHSSTNWPVIVALTTSGDDIWERCLQVGINGVIRKPVLLHGMANELRRVLLQPSKTLL

SEQ ID NO: 275 - protein, 217 aa, Eucaluptus grandis
MAGYRAEDDYDYLYKVVLIGDSGVGKSNLLSRFTKNEFNLESKSTIGVEFATRTLTVDGKVVKAQIWDTAGQERYRAITSAYYRGAVGALLVYDVTRHATFENVDRWLKELRNHTDPSIVVMLVANKSDLRHLIAVSTEDGKSYAERESLYFMETSALEATNVENAFAEVLTQIYRTTSKKTVEGDDGSAAAFPSQGEKINIKDDVSALKKVGCCST

SEQ ID NO: 276 - protein, 344 aa, Eucaluptus grandis
MQPSQPPPLNENYLRDDVKSQECEDLHSSLPSEEDWVPTSLPSEEDCVPSTLRLYQGFWFPSWVLNSVVACQNHFQAHPSDILLVTSPKCGTTWLKAILFALLNRAKYSDSNSQKRHPLLTQNPHDLVPFLEFRLYLQNKNPDLTAFASPRLLATHLPYSSLPRSVRDSNCKLVYLCRNPKDTFISMWHYFNKLRPEEKGQLPLPEGLDKFCRGVNWCGPYWDHVLGYHKASSEMPEKVLFVKYEEMKADPSVQVRRLADFMGRPFSEEELRNGTVEGILRMCSFDNLSALEVNRSGKLPSGLEKKWFFRKGEVGDWVNYMSAEMGEQIDGVMEEKLHGSGLKF

SEQ ID NO: 277 - protein, 220 aa, Eucaluptus grandis
MAILYAVVARGTVVLAEFSAVTGNTGAVARRILEKLPSEADSRLCFSQDRYIFHILRSDGLSFLCMANDTFGRRIPFSYLEDIQMRFMKNYGKVAHFAPAYAMNDEFSRVLHQQMEFFSSNPSADTLNRVRGEVSEMRTIMVDNIEKILDRGDRIELLVDKTATMQDGAFHFKKQSKRLRRALWMKNAKLLALLTCLILVLLYIIIAACCGGITLPNCRS

SEQ ID NO: 278 - protein, 370 aa, Eucaluptus grandis
MTGTMIGVTNANEQQALDRAQEVRQFEDSNLGVKGLLDSGLSTLPPMFIHPPDLLSSLKPVVGLKTDSIPIIDLSGSNSDRRPSVIEEVARAAREFGFFQIVNHGVPTEVLGQTIAAVKAFHEQPAEVKARIYRRESETGVAFFASSVDLLHSNVACWRDSLRIRSGPVLPDEEEIPEVCRNEVMEWNQQTQHLGVLLMGLLSEGLGLSPSKLQDMTCVEKRNMLGHYYPYCPQPDLTVGLKPHTDKGVITVLLQDQVGGLQVKHGEAWLDVTPSPGVLIVNIGDLLQIMSNDEYKSVEHRVLANPGPEPRLSVAVFYYPLECENQIGPIPELVSPEKPAAFRQFKLGEYLKRFQTEVLDGKTLKNHFKT

SEQ ID NO: 279 - protein, 327 aa, Eucaluptus grandis
MVVASPNPRRAEKIQAVELPAIDLSPSGRSAAPRLIVEACERYGFFKAVNHGVPAEIVSRMDEASAGFFARPASEKRLAGPADPFGYGSKSIGFNGDVGEVEYLLLESDPAFVSRRSASISDDPTRFSAAVNVYIEAVKDLACDILDLMAEGLGVRDTSVFSRLIRAVDGDSVFRINHYPQCAVLHGEVGFGEHSDPQILTVLRSNNVGGLQISLEDGVWTPVPPDPAAFWINVGDLLQAMTNGRFSSVRHRAVTNPFRSRTSIAFFGAPPLDARIAPQRELVTPRRPRLYNPFTWAEYKKAAYSLRLGDKRLDLFKACREDGGIDL

SEQ ID NO: 280 - protein, 621 aa, Eucaluptus grandis
MYRIQAGSAAAAGVEPGYCVETDPTGRYARFEEILGKGATKTVYKAIDEVLGMEVAWNQVKLNDSFRSPDEYQRLISEVHLLSTLNHDSIMKFHTSWVDVDGTAFNFITEMFTSGTLRNYRKKYPRLHIRAIKNWAVQILHGLVYLHSHDPPVIHRDLKCDNLFVNGHLGQVKIGDLGLAAILHGSRAAHSIIGTPEFMAPELYDENYNELVDVYSFGMCVLEMLTCEYPYIECTNPAQIYKKVTSGKLPEAFYRIKDSKARKFIGKCLANVSCRVSARELLHDPFLLSDEGDRLPGLKFKMPEPFLNGRDVDNLRARDNPLRTDMMITGKLNPEGDTIFLKVQIADRNSARNVYFPFDVLNDTPIDVAKEMVKELEIMDWEAEEIADMIGGEISALVPNWTKQDMTDYNQENDDGFAPPFLSFSSGSSSQASPSGFTAYRENEIASDYGCLQDVPDDMSSPSSIHSGTYSHTSYFCPEDQEVNPGPSNPDQHLISRSNRHTRFCADDYQRPRQFKDRSQTLQCQVLTGSDRDSSSVINRRMAGHRLSRNRSLVDVHSQLLHLSLLEEVSKRRLSRTVGEVENIGFQAPFEISRNAPWIGGSSFISSSRNKKGHRIQNRRN

SEQ ID NO: 281 - protein, 271 aa, Eucaluptus grandis
MDAGYLFKEETSLYNRIVLGSLLPASAWEPMPRLLQTWLRNYIGGTLIYFLSGFLWCFYIYYLKRNVYVPKDEIPTRKAMLLQIYVAMKAMPWYCALPTLSEYMVENGWTKCFSRISDVGWLAYLVYLSIYLVMAEFGIYWMHRELHDIKPLYKHLHATHHIYNKQNTLSPFAGLAFHPLDGILQAVPHVMALFLVPTHFTTHIALLFLEAIWTANIHDCIHGKLWPVMGAGYHTIHHTTYRHNYGHYTIWMDWMFGTLRDPIDDGSKKEM

SEQ ID NO: 282 - protein, 335 aa, Eucaluptus grandis
MAHQQLCSQSAIAGTEEHERKETDELIASLPQRKGAVRPFQCLYQNFWSPIFVLPNVITFQRHFEAKHKDIVLASQPKSGTTWLKALVFSIVNRFRFGISNTPLLTSNPHELVPFFEFQLYGSKLRPNLDGLAEPRLFATHIPYPSLPECIKRSECQIIYICRNPLDTVVSSWHFFLEKARLEDQPEWSLEEHFETYCQGTISFGPFWDHIMGYWKMSLEWPSKVLFLKYEDLKEDTVVHLNRVAEFVGLPFTEEEEEAGVIEEIAKMCSLKTLKDLEVNKSGKVALTIEFEKRSFFRKGEVGDWVNHLTPSMVDRLNSIIQEKMSPFGLEFKTC

SEQ ID NO: 283 - protein, 257 aa, Eucaluptus grandis
MPESREDSVYLAKLAEQAERYEEMVENMKRVASSDQELTVEERNLLSVAYKNVIGARRASWRIVSSIEQKEESKGNEAQVSMIKGYREKIEQELAKICEDILEVLDKHLIPSAASGESKVFYHKMMGDYHRYLAEFATGDKRKDSADKSLEAYKAASDVAVTELPPTHPIRLGLALNFSVFYYEILNSPDRACHLAKQAFDDAIAELDTLSEESYKDSTLIMQLLRDNLTLWTSDMQDSADKPADTKEEAGDAPAED

SEQ ID NO: 284 - protein, 370 aa, Eucaluptus grandis
MSSSSSGGDGGGGPKLPHDVAVDILKRLPARSLLRFRCVCRSWRSAIDDPRFVALHLSHSALHASSRHLACLDCGEDAVQNRCSLFPNAPLALPPPPLQIEIPFVAPPNRYALVGSCNGLICVSESSSDGTERALYFWNLFTRKHKAVRLPRPERMPPLSVGGAHVVLGFCFDAKSNDYRVVRIIRYLGIRRRRFRNKKPRVEVYSFRTDSWKTLECEVPLLCDSAVFLNGNLHWYSFNGEGDGYGSIVLFNVADEVFDEIALPEGISPHFVLSVAVLNDSLAVFFSDGEACFVWVMKDYGVPESWSKLYTFEVTGPVTAFDGFTWNGELLMEINCEERVSWNPITAQLSILPLLARYELLPVVESLVPP

SEQ ID NO: 285 - protein, 206 aa, Eucaluptus grandis
MPSRRRTLLKVIILGDSGVGKTSLMNQYVNKKFSNQYKATIGADFLTKEVQLDDRLFTLQIWDTAGQERFQSLGVAFYRGADCCVLVYDVNVMKSFDNLNNWREEFLIQASPSDPENFPFVVIGNKIDVDGGNSRVVSEKKARAWCASKGNIPYFETSAKEGVNVEEAFQCIAKNALKSGEEEEIYLPDTIDVANSSQPRPSGCEC

SEQ ID NO: 286 - protein, 301 aa, Eucaluptus grandis
MAHLNQFVGRTANLCLCVQQNSRLPYLSGVPSVEDLKYRLMGPSDQIRVLGSCGRLCIIDVADEINVWDPSTRQSMPLPHSAVEIRRPSALPICVYGFGCDVRNGAFKLLRLIQLATGQRRSEVSIYNMIDQNWRRLPEIAYNLVYPDKMGVFAYGRLHLTVTPERLACSPAKLLLAFDCHTEEFEEVELPDNIDKKRDMVVAVLDGRLCLSIDRIDMFADVWILRVYGSQESWAWVFSIPKYDDDRIPRFVWPLACSEDHHHVLVRKDNKDVVWYDLHARYINRVDIRGMPSSFKDAYVM

SEQ ID NO: 287 - protein, 479 aa, Eucaluptus grandis
MGAWLGCILGLIPLLGCCLWWWNEIRYVWPVKRRCSGTNAKLPPGHMGFPFFGELFTFLWYYKILRRPDEFINSKRKKYGDGVGMYRTHLFGSPSIIACVPSVNKFVFRAEDTFIAQWPNVDIMGTNSLGAVHGKAHDRLRSFVLNAVNRPDALRRIAALVQPRLVSALELWAQKGRIVAFHETKKVTFENIGKLFVSFEPGPQLEKIDGLFHDMLKGMRAQRLNFPGTAYRCALQARKKVEAIFRVELEERKSRSEETVTDLMDELRQIKDEEGRKLSDQEVLDNIVSFVFAGYESTSLASMWAIYYLAKSPNVLKKLREENTSVSQNKKGEFITSEDISNMKYTKKVVEETLRMANISHFLFRLVTKDIEYKGYRIPKGWKVILWLRYLHTNPENFDDPMCFNPERWNDSVKPEAYQVFGGGSRICPGNMLARIQLAILLHHLSVEYKWELINSDAGFVYLPHPAPVDEVEVSFSKL

SEQ ID NO: 288 - protein, 331 aa, Eucaluptus grandis
MVVPSKLAIEQFSYVMNSNALSSHQIPVVDLSKPDSKSLIIKACEECGFFKVVNHGVPLDFISRLEEEAVKFFSLPLPEKERAGPPDPFGYGNKMIGRNGDVGWIEYLLLTTDPNFNYRKLPSAFNENPERFRSALSDYTSAVRYMACEILELMADGLRIQQRNIFSKLLMDEQSDSVFRLNHYPPCPELQSYVDRNMIGFGEHTDPQIISVLRSNNTSGLQISMKDGTWVSVPPDQNSFFINVGDSLEVMTNGRFRSVRHRVLANTSKSRVSMIYFGGPPLSEKIAPLPCLMKGKESLYKEFTWFEYKKSAYNTRLADNRLEHFQRVAAS

SEQ ID NO: 289 - protein, 465 aa, Eucaluptus grandis
MAVYIFLALGVVLVLCVCTALLRWNEVRYMKKGLPPGTMGWPVFGETTEFLKQGPNFMKNQSARYGSFFKSHILGCPTIVSMDPEVNRYILMNEAKGLVPGYPQSMLDILGKRNIAAVHGASHKHMRGALLSLVSPTMIRDQLLPKIDRFMRSHLARWDDGSIIDLQDKTKQMALLSSLMQIGIDSSSISQEFIPEFFKLVLGTLSLPIDLPGTNYRRGFQARKNILGMLRKLIEERRASQEAHNDMLGCLMRSDDNKYKLNDEEIIDQIITIMYSGYETVSTTSMMAVKYLHDNPSVLHELRKEHLGIRAKKRPEDPIEWDDLKAMRFTRAVIFETSRLATVVNGVLRKTTKDMELNGFLIPKGWRIYVYTREINYNLRLYPDPLAFNPWRWLDKSVECQNYNLIFGGGTRQCPGKELGIAEISTFLHYFVTRYRWEEIGGDKLMKFPRVEAPNGLHIRVSPQC

SEQ ID NO: 290 - protein, 259 aa, Pinus radiata
MSAEKERESHVFMAKLAEQAERYDEMVQSMKDVAKLDLELSVEERNLLSVGYKNVIGARRASWRIMSSIEQKEEAKGNEQNAKRIRDYRQKVEDELCRICNDILSIIDDHLLPSSTSGESTVFYYKMKGDYYRYLAEFKSGNERKEIADQSLKAYEAASNTAATDLPPTHPIRLGLALNFSVFYYEIQNSPERACHLAKQAFDEAIAELDTLSEESYKDSTLIMQLLRDNLTLWSSDLEDLGGDDQPKGEEAKVEDGEP

SEQ ID NO: 291 - protein, 199 aa, Pinus radiata
MSARRRTLLKVIILGDSGVGKTSLMNQYVNKKFSNQYKATIGADFLTKEVQFEDRLFTLQERFQSLGVAFYRGADCCVLVYDVNVLKSFDNLNNWRDEFLIQASPSDPENFPFVVLGNKIDVDGGNSRVVSEKKARAWCASKGNIPYFETSAKEGFNVEAAFQCIAKNALKNEPEEEIYLPDTIDVNAGRPQRTSGCDC

SEQ ID NO: 292 - protein, 206 aa, Pinus radiata
MSARRRTLLKVIILGDSGVGKTSLMNQYVNKKFSNQYKATIGADFLTKEVQFEDRLFTLQIWDTAGQERFQSLGVAFYRGADCCVLVYDVNVLKSFDNLNNWRDEFLIQASPSDPENFPFVVLGNKIDVDGGNSRVVSEKKARAWCASKGNIPYFETSAKEGFNVEAAFQCIAKNALKNEPEEEIYLPDTIDVNAGRPQRTSGCDC

SEQ ID NO: 293 - protein, 546 aa, Pinus radiata
MKRASYGCISDEALECVMGHLEDPRDRGSVSLVCKKWYDVDAFTRKHVTVAFCYSIHASDLTRRFTRLESLTVKGKPRAAMYNLLPHDWGGYAKPWIDQISFTCLCLKALHLRRMIVTDDDLTTLVRGRGHMLQELKLEKCSGFSTRGLEEVAHGCRSLKILMLDESQIEEESGDWLHELALNNSSLEVLDFYMTTLEMINTSDLELIVTNCPSLTSLKVGECDIVEMRGVLSKATALEEFGGGTFNNSEEHATETSMITFPPKLTSLLGLNFMIEAEMPAIFPRASALKRLDLQYTFLSTENHCQLAGLCPNLEILEVRNVIGDKGLEVVANTCKKLKRLRVERGADDPTLEDEQDKEEHIADLPLDNGVRALLRGCQKLSRFAFYIRPGGLTDTGLGYIGEYSTNVRWMLLGFVGETDQGILEFSKGCPKLERLEIRGCCFSESALAAAVLQLKSLKYIWVQGYNATVTGANLLAMARPYWNIEFSPALQSSDVFAEDMAEEKKQDQVAQLLAYYSLAGRRTDHPESVIPLAPLFWNCHQVTVF

SEQ ID NO: 294 - protein, 602 aa, Pinus radiata
MKRASYGCISDGCISDEALECVMGHLEDPRDRGSVSLVCKKWYDVDAFTRKHVTVAFCYSIHASDLTRRFTRLESLTVKGKPRAAMYNLLPHDWGGYAKPWIDQISFTCLCLKALHLRRMIVTDDDLTTLVRGRGHMLQELKLEKCSGFSTRGLEEVAHGCRSLKILMLDESQIEEESGDWLHELALNNSSLEVLDFYMTTLEMINTSDLELIVTNCPSLTSLKVGECDIVEMRGVLSKATALEEFGGGTFNNSEEHATETSMITFPPKLTSLLGLNFMIEAEMPAIFPRASALKRLDLQYTFLSTENHCQLAGLCPNLEILEVRNVIGDKGLEVVANTCKKLKRLRVERGADDPTLEDEQGWISHKGLSLVAQGCPLLEYIAVYVSDICNSTLETFGQCCKNLKDFRLVLLDKEEHIADLPLDNGVRALLRGCQKLSRFAFYIRPGGLTDTGLGYIGEYSTNVRWMLLGFVGETDQGILEFSKGCPKLERLEIRGCCFSESALAAAVLQLKSLKYIWVQGYNATVTGANLLAMARPYWNIEFSPALQSSDVFAEDMAEEKKQDQVAQLLAYYSLAGRRTDHPESVIPLAPLFWNCHQVTVF

SEQ ID NO: 295 - protein, 230 aa, Pinus radiata
MFTISTCTTHAQSLIYSFVARGTVVLAEYTEFKGNFTGIAAQCLQKLPASNNKFTYNCDNHTFNYLVEDGFAYCVVADESVGRQVPMAFLERVKEDFKRRYGGGRADTAVANSLNRDFGSKLKEHMQYCIDHPEEISKLAKVKAQVSEVKGVMMDNIEKVLDRGEKIELLVDKTENLRFQAQDFQKKGTELRRKMWFQNMKVKLIVLGIVVALILIIVLSVCHGFNCSKK

SEQ ID NO: 296 - protein, 259 aa, Pinus radiata
MTTEKERENHVYMAKLAEQAERYDEMVDSMKKVAKLDVELTVEERNLLSVGYKNVIGARRASWRIMSSIEQKEEGKGNDVNAKRIKDYRHKVETELSRICGDILTIIDEHLIPSSSSGESMVFYYKMKGDYYRYLAEFKSGSDRKETADQALKAYLAASTTATTDLPPTHPIRLGLILNFSVFYYEILNSPERACHLAKQAFDEAIAELDSLSEESYKDSTLIMQLLRDNLTLWTSDLQEDGGEEQLKGEEIKPEDGEH

SEQ ID NO: 297 - protein, 337 aa, Pinus radiata
MSSRERKARVGLKLPIPAREDAFAKPMPLPLPLPKPPNMNGACKLPCVPLEEVTLEDLQKISTLGCGSSGKVYKVKHAKTGKIYALKIIQEKHELAVRKQIMREMEILRRANSPHIVQCYGIFDRGGEISFVLEYMDGGTLAQVLQAHKKIPEHYLAEVARQVLKGLHYLHQNKIVHRDIKPSNLLINKRREVKIADFGVSTVLAHTLAQCNSFVGTCAYMSPERFDPDGYGGKYDGCSADIWSLGLSLLECALGRFPCLSPGQRPDWPTLMVAICLGDPPSPPPDASPEFQSFIRCCLQKDALLRHTAHRLLSHPFLKKYEQQSCDLAPLLQSLHL

SEQ ID NO: 298 - protein, 200 aa, Pinus radiata
MATTGTNNMQAKLVLLGDMGTGKSSLVLRFVKGQFLDYQESTIGAAFFSQTLAVNEVTVKFEIWDTAGQERYHSLAPMYYRGAAAAIIVYDITNLDSFVRAKNWVLELQKQGNPNLVMALAGNKADMAAKRKVEPEEAETYAKENGLFFMETSAKTAQNVNELFYEIARRLPKARPVQQPAGMVLTDRPAESAKTYSCCS

SEQ ID NO: 299 - protein, 372 aa, Pinus radiata
METGAAAVDGHIQGILTHGGQYVQYNIFGNLFEVFSKYIPPIRPIGRGAYGIVCSAVNSETNEEVAIKKIGNAFDNRIDAKRTLREIKLLCHMEHENIIAIKDIIRPPQREIFNDVYIVYELMDTDLYQIIRSTQPLTEDHCQYFLYQLLRGLKYIHSANILHRDLKPSNLLLNANCDLKICDFGLARTTSETDFMTEYVVTRWYRAPELLLNCSEYTAAIDIWSVGCIFMEILKREPLFPGKDYVQQLRLITELIGSPDDSDLGFLRSDNARRYIRQLPQFPKQPFSQKFPNMAPAAVDLLEKMLVFDPSKRITVQEALSHPYLASLHDINDEPSCPTPFNFDFEQPSFTEEHIKELIWRESLNFNPDMMQ

SEQ ID NO: 300 - protein, 220 aa, Pinus radiata
MRVTEQPEDYLFKIVLIGDSAVGKSNLLARYARNEFYPNSKSTIGVEFQTQTMEIDGKEIKAQIWDTAGQERFRAVTSAYYRGAVGALVVYDISRRQTFDNISRWLDELHTHSDMNVVTVIVGNKTDLMDAREVSTEEGAALAEAQNLYFVETSALDSTNVQVAFQTVVKEIYNILSRKVLSCQEQKLESKLTNGKTVILHEAESESTTKQTGKFWCCSG

SEQ ID NO: 301 - protein, 223 aa, Pinus radiata
MMSYAGEEQPEDYLFKIVLIGDSAVGKSNLLARYARNEFYPNSKSTIGVEFQTQTMEIDGKEIKAQIWDTAGQERFRAVTSAYYRGAVGALVVYDISRRQTFDNISRWLDELHTHSDMNVVTVIVGNKTDLMDAREVSTEEGAALAEAQNLYFVETSALDSTNVQVAFQTVVKEIYNILSRKVLSCQEQKLESKLTNGKTVILHEAESESTTKQTGKFWCCSG

SEQ ID NO: 302 - protein, 206 aa, Pinus radiata
MATRKRTLLKVIILGDSGVGKTSLMNQYVNKKFSNQYKATIGADFLTKEVQVEDRLVTMQIWDTAGQERFQSLGVAFYRGADCCVLVYDVNVIKSFDNLDNWHQEFLIQANPNDPDNFPFVVLGNKTDVDGGHSRVVSEKKAKMWCAAKGNIPYFETSAKEDMNVEEAFQCIAKNALKNEPDEEIYLPETIDVGHIGVQRPSACQC

SEQ ID NO: 303 - protein, 206 aa, Pinus radiata
MATRKRTLLKVIILGDSGVGKTSLMNQYVNKKFSNQYKATIGADFLTKEVQVEDRLVTMQIWDTAGQERFQSLGVAFYRGADCCVLVYDVNVIKSFDNLDNWRQEFLIQANPNDPDNFPFVVLGNKTDVDGGHSRVVSEKKAKMWCAAKGNIPYFETSAKEDMNVEEAFQCIAKNALKNEPDEEIYLPETIDVGHIGVQRPSACQC

SEQ ID NO: 304 - protein, 230 aa, Pinus radiata
MVLRISELTIGYVYTGLKLKEAWIMATRKRTLLKVIILGDSGVGKTSLMNQYVNKKFSNQYKATIGADFLTKEVQVEDRLVTMQIWDTAGQERFQSLGVAFYRGADCCVLVYDVNVIKSFDNLDNWRQEFLIQANPNDPDNFPFVVLGNKTDVDGGHSRVVSEKKAKMWCAAKGNIPYFETSAKEDMNVEEAFQCIAKNALKNEPDEEIYLPETIDVGHIGVQRPSACQC

SEQ ID NO: 305 - protein, 497 aa, Pinus radiata
MGQGASSSSVVHALKREENDVNLGRDYSLSLPDECLACIFCTLSSGDRQRCSLVCKRWFLVEGSSRQRLSLDARLDISAAIPGLFSRFDHVTKLALRCDRRMVSIKDEGLIKIGIHCKSLKKLKLKACRELSDVGIEDFAKLCTGLKKLSCGSCTFGAKGMNAVLKYCVGLEELSVKRLRGLADGSVDVIGPGCAMLKSICLKELFNGQYFGPLIAGSKNLRTLKLFRCSGDWDKLLEVITDHVSGLVEVHLERLQVSDRGLMAVSRCAGLEVLHLVKTPECTNVGLAAIANNCKNLRKLHIDGWKTNRIGDEGLIAVGKKCQNLQELVLIGLNLTATSLSPLASNCQVLERLALCGSETIGDTEISCIAAKCLSLKKLCIKGCPVSDDGIESLVSGCPKLVKVKVKKCRGVTWEGAERLRANRGSLAVNLDTPLPNPVVGPPSGAGAAEASAPSTSKSSIAKAKFSLFAGRNLVACAFLRLSNGSDGDHKRVSANA

SEQ ID NO: 306 - protein, 216 aa, Pinus radiata
MAYKVDDDYDYLFKVVLIGDSGVGKSNLLSRFTRNEFSLESKSTIGVEFATRSINVDGKMIKAQIWDTAGQERYRAITSAYYRGAVGALLVYDITRHVTFENVERWLKELRDHTEHNIVVMLVGNKSDLRHLRAVSTEDAQTFAEREGLYFIETSALESTNVENAFKQVLTQIYRIVSKKALDVSEDNAAAPAQGQTINVKDDVTATKKVGCCSTS

SEQ ID NO: 307 - protein, 260 aa, Pinus radiata
MSSDKERENHVYMAKLAEQAERYDEMVEAMKRVAKLDVELTVEERNLLSVGYKNVIGARRASWRIMSSIEQKEDAKGNDHNVKRIKEYRQKVEAELSKICHDIMTIIDEHLIPSSNIGESTVFYYKMKGDYYRYLAEFKTGNERKEAADQSLKAYQTASSTAESDLAPTHPIRLGLALNFSVFYYEIMNSPERACHLAKQAFDEAIAELDTLSEESYKDSTLIMQLLRDNLTLWTSDLQEDGVEDQTKGDEPVVGMDEEL

SEQ ID NO: 308 - protein, 260 aa, Pinus radiata; identical to SEQ ID NO: 307

SEQ ID NO: 309 - protein, 259 aa, Pinus radiata
MVESSREENVYMAKLAEQAERYEEMVEFMEKVTKGVEVEELTVEERNLLSVAYKNVIGARRASWRIISSIEQKEESRGNDEHVVTIREYRAKVEAELSKICEGILRLLDSHLIPSSTAAESKVFYLKMKGDYHRYLAEFKTGAERKEAAENTLLAYKSAQDIAAAELAPTHPIRLGLALNFSVFYYEILNSPDRACNLAKQAFDEAIAELDTLGEDSYKDSTLIMQLLRDNLTLWTSDMQEDAGEEIKETSKREDGEEQ

SEQ ID NO: 310 - protein, 511 aa, Pinus radiata
MDGMSTRGGSNFDMYLPNYKLGKTLGIGSFGKVKIAEHALTGHKVAIKILNRRKIRNMDMEEKVRREIKILRLFMHPHIIRLYEVIETPSDIYVVMEYVKSGDLFDYIVEKGRLQEDEARCFFQQIISGVEYCHRNMIVHRDLKPENLLLDSKCNVKIADFGLSNVMRDGHFLKTSCGSPNYAAPEVISGKLYAGPEVDVWSCGVILYALLCGSLPFDDENIPNLFKKIKGGIYTLPSHLSSGARDLIPRMLVVDPMKRMTIPEIRQHPWFLEKLPRYLAVPPPDTIQQAKKIDEEILQEVIKRNFDRNQLVESLRSRIQNEATVAYYLMLDNRSRISNGYLGSEFQEAKDCIHHFVPTDRATPTGDHRLTGFINQGNASRSQFPIERKWALGLQSQAHPREIMSEVLKALQELDVAWKKIGHYNMKCRWFPAVLRKVDSSMNKSLHGNHIIQDDSTAGINCRSPPNVVKFEVQLYKAREEKYLLDLQRVQGPHFLFLDLCADFLAQLRVL

SEQ ID NO: 311 - protein, 544 aa, Pinus radiata
MTIARRCSSLIVRGVRSAGSRSSAVGSPALSKQASTKNSRIQRFGTAASALEEPIAPPVQVKYTHLLIDGQFVNAASGKTFPTFDPRTGDLIADVAEGDAEDVDRAVKAARKAFDEGPWPKMTAYERSCIMYRFADLLEKHNDEIAALETWDNGKPYEQSSLVEVPMAIRVFRYYAGWADKIHGLTIPADGPYHVQTLHEPIGVAGQIIPWNFPLLLFSWKVAPALACGNTIVLKSAEQTSLTAIYAAKLFHEAGLPSGVLNIIPGYGRTAGVAIAKHMDIDKLAFTGSTETGKAVLELASKSNLKRVTLELGGKSPFIVCEDADVDQAVELAHSALFFNQGQCCCAASRTYVHESIYDEFVEKTKARCLSRVVGDPFKKGVEQGPQIDQMQFNKIMSYIKAGKESGAKLVTGGEQIGTKGFYIMPTVFSEVQDDMPIATDEIFGPIQSILKFKDINEVIKRANGTDYGLAAGVFTKSMDTANTLTRALRAGSIWINCFHIFDAGVPFGGYKMSGTGRQKGIYGLQSYLQVKAVVTPLKNPAWL

SEQ ID NO: 312 - protein, 547 aa, Pinus radiata
MAAMRAGRGFSSLLTRAVRSAGTRSPAVGLAALSQEASIKNTGIRSLGTAASALEEPIAPPVQVQYTQLLIDGQFVNAASGRTFPTLDPRTGDLIVDVAEGDAEDVDRAVKAARKAFDEGPWPKMTAYERSCIMLRFADLLEKHNDEIAALETWDNGKPYEQAALVEVPMVVRLFRYYAGWADKIHGLTVPADGPYHCQTLHEPIGVAGQIIPWNFPLLMFAWKVGPALACGNSIVLKSAEQTPLTALYAAKLFHEAGLPPGVLNVISGYGPTAGAAIARHMDIDKVAFTGSTSTGQAVLELASKSNLKPVTLELGGKSPFIVCKDADVDQAVELAHFALFFNQGQCCCAGSRTFVHESIHDEFVEKAKARCLSRVVGDPFRKGVEQGPQIDREQFNKVMGYIKSGRESGAKLVTGGDQIGTKGFYIMPTIFSEVKDDMGIATDEIFGPVQSIIKFKTLDEVIKRANATRYGLAAGVFTKNIETANSLTRALRVGTVWVNCFDIFDAGIPFGGYKMSGTGREKGIYSLNNYLQVKAVVSPLKNPAWL

SEQ ID NO: 313 - protein, 712 aa, Pinus radiata
MKRQHFQLQQQQQPQPNGHGRCCSTVPVHPNPVSMPGSGPPPQAPRTTATAPAAGAAAAGGGGSSGSCKGKEVVLKDTCKQGVGVDMELASMGYSVKSSELEQVAHRLEQLEMMMCNGQEDGIISHLSSEAVHYNPSDLGGWIESMLSELHVPILPPTDQPFQFPQAAADQSSTVREASNSVPESSTSTSKGTRSVQNVEQDQQYRLNGSGAGLFEPPEVLDRSEFQLHGYPGQGGVRDNGIDRMFGNYGGLFSQVLDVSDLLVDDPDVLQEPPPQEASPSTLLLQSSSNSSLEVQSGQDRLEEDVTGREQKRYRVCDPELSERTVVVMGADPHESGVRLVHTLMACAEAVQRGNLAIAREMVKEVRILASAQGGAMSKVATYFAEALARRIYGFLPQDTLRFNQNDPLSDFLQFHFYQTCPYLKFAHFIANQAILDAFSGHQQVHVIDFNLKQGIQWPALIQALALRPGGPPAFRLTGIGPPQPDGTDALQEVGTRLHQFAESVNVKFSFRGYVATSLADIKPWMLDARPELEAVAVNSILELHRLLEDPIPGRPSAIDRVLASIWSLKPKILTVVEQEADHNRPVFLDRFTEALHYYSTVFDSLEARGLQAQSEEQVMSEVYLGREICNIVACERSERVERHEPLLNWSVRLRNAGFWPIPLGSNAFKQASMLLSLFSGGEGYRVEENNGCLTLGWHSRPLIAASAWQRC

SEQ ID NO: 314 - protein, 402 aa, Pinus radiata
MAYSGRARRPISFLLKQLKTSHSYSSWTRCNGFNGQSMFQSNAISRCKAPSFRPTAELGWVLGFSHSCRGYSAEVGSTEQVGLIKQLRERTSAPMKDVKAALVDCNWDLEAAYTELRKKGIAGASKKGARIAAEGILALAQDEKVAAVIELNCETDFVARNEIFQYLAHSVAKSALTMEALPELLSESATLDLKLLGEMNIILDHPKLTREITVQDAIMEVAAIMGENVKLRRGFALSSANGVVSSYLHTSPQPGLGRIAGLLTLESENGGAPTEVLQRVGSNLAMHVVAARPLFLSKDHVATKTLEAERDILKTQAAASGKPQAAIEKMVEGQLRKFVEEIALLEQKFVMNDKVNVKSVLEDLSKEVGQQIRVGSFLRVEVGEGIHRQETSFASEVAAQVG

SEQ ID NO: 315 - protein, 372 aa, Pinus radiata
MEASAAAADGHIQGILTHGGRYVQYNIFGNLFEVSSKYVPPIRLIGQGAYGIVCAAVNSETNEQVAIKKIGNSFANRIDAKRTLREIKLLCHMDHENIIAIKDVIRPPQRENFKDVYIVYELMDTDLCQIIHSKQPLSVDHCQYFIYQLLRGLKYIHSANILHRDLKPGNLFLNEDCDLKIGDFGLARTTSDTDSMTEYVVTRWYRAPELLLNCSEYTAAIDIWSVGCIFMEILKREPLFPGSNYVEQLKLITEFIGSPDDSDLGFLRSDNTRRYIRQLPQVPKQPFAQKFPNMDEDALDLLEKMLVFDPSKRITVEEALSHRYLASLHGINEEPRCPAPFNFDFEQGTFTEEHIKELIWRESLNFNPDMME

SEQ ID NO: 316 - protein, 333 aa, Pinus radiata
MAVPVIDMKKMLNGEEREVTMAKIQNACQEWGFFQLLNHGIPHALLDRVKELFKEHYKNSMDAEFQKSEIVGMLESAVSQGKNFGTTKIDDDWETGFFLQDETYDTVSPPLPTNLKETMKEFSEEVKILAERILDIICENLGLEKGYLKEAIAGGNGDGKAPFFGIKMAHYPPCPRPELVDGLRPHLDAGGVILLLQDDEVGGLQVLKDGTWFDVEPIRHAIVIDIGDQLEVMTNGKCKSMWHRVLSKKDANRMSVAAFYNPSTNAEVFPAPQLIMKATEQNGNENDNNNMNAQSGYSYPKFVSKDYMKVYGEQKFLEREPRFEAMRALCSLK

SEQ ID NO: 317 - protein, 341 aa, Pinus radiata
MPAKNGASLSSPFNIFFMSITGTAMKKMLNGEEREVTMAKIQNACQEWGFFQLLNHGIPHALLDRVKELFKEHYKNSMDAEFQKSEIVGMLESATKIDDDWETGFFLQDETYDTVSPPLPTNLKETMKEFSEEVKILAERILDIICENLGLEKGYLKEAIAGGNGDGKAPFFGIKMAHYPPCPRPELVDGLRPHLDAGGVILLLQDDEVGGLQVLKDGTWFDVEPIRHAIVIDIGDQLEVMTNGKCKSMWHRVLSKTDANRMSVAAFYNPSTNAEVFPAPQLILKATEQNGNGNDNNNMNAQSGYSYPKFVSKDYMKVYGEQKFLEREPRFEAMRALCSLK

SEQ ID NO: 318 - protein, 222 aa, Pinus radiata
MASPYGDYDQRIDYMFKVVVIGDSAVGKSQILSRFAKNEFSLDSKSTIGVEFQTRTVAIDNKTIKTQIWDTAGQERYRAVTSAYYRGALGAMLVYDITKRQSFDHVARWLEELRGHADNNIVIMLIGNKCDLRDMRAVPEEDAKEFAQREGLYFFETSALEAINVEMAFITALTEIYRIVSRKALTANEDERNGNAAALTGTKISLSSPEQSVMAVKKKSCC

SEQ ID NO: 319 - protein, 271 aa, Pinus radiata
MDRLISGQTTCNSVEKQSNGDSNLDYSVSDAVRDKLRLMRDRIEKEDPASKVTDDGTLLRFLYARESNVEKACEMFAKYRKWRQTYVPLGYIPETMVGNELKHKFVYMQGYDKVGRPIMVLRLARHIASQSNMEDFKRFVVYAFDKMSASATKGQTKFSIIADFADWAYKNVNLRGTIAAVQTLQDFYPERLGKVYLINRPYIFWAAWKIVSPFIDKVTRQKIVFTDDKYVKETLLKDIDENQLPEIYGGKLPLVAIDDCVVPNWPPITSF

SEQ ID NO: 320 - protein, 258 aa, Pinus radiata
MTEKERENHVYMAKLAEQAERYDEMVDSMKKVAKLDVELTVEERNLLSVGYKNVIGARRASWRIMSSIEQKEEAKGNELNVKRIKEYRHKVEDELSRICNDILTIIDEHLIPSSSTGESTVFYYKMKGDYYRYLAEFKTGNERKEAADQSLKAYQAASNTATTDLAPTHPIRLGLALNFSVFYYEILNSPERACHLAKQAFDEAIAELDTLSEESYKDSTLIMQLLRDNLTLWTSDLQEEGGEDQPKGEEDKIEEIEH

SEQ ID NO: 321 - protein, 219 aa, Pinus radiata
MVKLTMIARVTDGLPLAEGLDDGREQRDLEFYKQQAKALFKKLSHGQHEPSRMSIETGPFIFHYIIEARVCYLTMCDRSYPKKLAFQYLEELKNEFEKLYQSQVETVARPYAFIKFDTFIQKTRKLYLDTRTQRNLAKLNDDLYEVQQIMTRNVQEVLGVGEKLDQVSQMSSRLSSESRKYADKAKDLSRQAFIKKWAPVAIVLGVVFVLLWMRWYIWQ

SEQ ID NO: 322 - protein, 213 aa, Pinus radiata
MARRTDDEYDYLFKVVLIGDSGVGKSNLLSRFTRNEFCLESKSTIGVEFATRTVQVEGKTIKAQIWDTAGQERYRAITSAYYRGAVGALLVYDITKPTTFENVGRWLKELRDHADSNIVIMLVGNKSDLKHLRGVSTEDAQSFAEKEGLSFLETSALEATNVERAFQTILAEIHRIISKKALASEEAAGAGIREGKTILVSEPDSNTKKACCS

SEQ ID NO: 323 - protein, 585 aa, Pinus radiata
MDQDQSICRFAAQKGKGEIQSSSFPDEVLEHVLVFLSSQKDRNSVSLVCKAWHRVEAWTRQQVFIGNCYAVSPQIMIKRFPKIKSVSLKGKPRFADFNLVPPNWGAHLTPWVSAMATAYPLLERLYLKRMTITDYDLTLLANSFLYFKELVMVCCDGFSTGGLASIASKCRQLTTLDLNEDEIHDNGEDWLACFPETLTSLRSLCFDCLEGPVNFDALERLVARCPSLKKLRLNRNVSIVQLQRLIIKAPQLTHLGTGSFFYEFQLEQVADLLAAFSNCKQLQCLSGFREVVPEYLPAVYPVCSNLTSLNFSYAVIGSRELEGIVCHCRKLQLLWVLDSVGDKGLEAAATTCKDLRDLRVFPVDAREDGEGCVSERGLVAISEGCPNLESILYFCQRMTNKAVVTMSHNCSKLASFRLCIMGRHQPDHLTGEPMDEGFGAIVRNCKSLTRLAVSGLLTDKAFQYFGAYGERLETLSVAFAGESDLSMKYVLDGCKNLRKLEIRDSPFGDVALLSGLHHYENMRFLWMSDCRLTLQGCTELAKKMPGLNVEIIRENECNDSLVEKLYAYRTVAGPRKDMPSFVTIL

SEQ ID NO: 324 - protein, 576 aa, Pinus radiata
MQQDQRRKNSSEIEFFTEYGGASRYKIQEVIGKGSYGVVCSAIDTHTGEKVAIKKITNIFEHLSDATRILREIKLLRLLRHPDIVEIKHIMLPPSQREFKDIYVVFELMESDLHQVIKANDDLTPEHYQFFLYQLLRALKYIHTANVFHRDLKPKNVLANADCKLKICDFGLARVAFNDTPTAIFWTDYVATRWYRAPELCGSFFSKYTPAIDIWSIGCIFAEVLTGKPLFPGKNVVHQLDLMTDLLGTPSPETIARVRNEKARRYLNSMRKKQPVPFTQKFVGADHLALKLLERLLAFDPKDRPTAEEALADPYFRGLAKVAREPVAQPITKMEFEFERRRVTKDDVRELIYREILEYHPQIMKEYLNGTDRTNFMYPSAVDQFKRQFAHLEEHYGKGGSVPPLERQHASLPRPCVVYSNSGGPSSEQASSGPSRDRALEVREEAPRYSREGEKQHQDRSSGNVKVPLHASHKVLQGSTAKPGKVIGPVLPCENGSIKEAYNPRRLIRNAGVAPSQCPAPIYSYPRRNSTAKTEVDDKREDGINQFNVSQHKTQYVGIGAARKVAALESRSSHLY

SEQ ID NO: 325 - protein, 149 aa, Pinus radiata
MADDLGEFYVRYYVGHKGKFGHEFLEFEFRPDGKLRYANNSNYKNDTMIRKEVFLTQAVLRECRRIIAESEIMKEDDNNWPEPDRVGRQELEIVMGNEHISFTTSKIGSLVDVQSSKDPEGLRIFYYLVQDLKCFVFSLIGLHFKIKPI

SEQ ID NO: 326 - protein, 159 aa, Pinus radiata
MPPTSDRIPAMADDLGEFYVRYYVGHKGKFGHEFLEFEFRPDGKLRYANNSNYKNDTMIRKEVFLTQAVLRECRRIIAESEIMKEDDNNWPEPDRVGRQELEIVMGNEHISFTTSKIGSLVDVQSSKDPEGLRIFYYLVQDLKCFVFSLIGLHFKIKPI

SEQ ID NO: 327 - protein, 317 aa, Pinus radiata
  MOD_RES (187): Any amino acid
MGHNTSEAIKQMTAFIDGVDEPLKKSFQTMHRGYAQQTLERFLKAREGNVQKANKMLLDCLSWRVQNHIDNILAKPIEPREVYNAVRESQLMGMTGYCKKGRPVFAIGVGLSGYDKASADKYVQSHIQINEYRTKFSLPNASKKYGSYIGPCLKILDMTGLKLSALNRIKILTTIATVDDLNYPAEXRSTYYIVNAPYVFSACWKVVKPLLQEGLDEKLQVLQGCGREELLKVMDYDVLPHFSRQEGSGSSKHHNGKTIDCFSPDHPFHVELYNYIKQQAAIIKPVAPEKMRSFHVDVPEQDDEGTIIVQTLRICIT

SEQ ID NO: 328 - protein, 485 aa, Pinus radiata
MAETVTYSWPVGFVCFVLTMLLLQLYRIVWREDSRGYNLPPGSSGWPLIGETLSFMRGINSISKPRQFIQDREQRYGKIFRTNLFGRSRMIVSVDPEFNKYILQHEGRLVQSSYLRPFRKLIGKYGLLSVYGDLQKKLHGTAVNFLRFERLSVHFMEDIQNLMHTTFAQWQAKGHIHLYHECHQFVLNLMAKQLLDLSPSKETEEIGKAFGDFSKSFVVLPIRIPGTAYWKGLKARDFLMKKIYASIKYRREHPEVVHNDFLGELLKEDLHSEEIIADFVLFLLFAGHETSASTMAFAIKFLTDCPQALRELKAEHNALLKRKGSPRNQNLTWDDYQSLKFTQCVINETHRLANVAPAVFREAIADIKIKGFVIPKGWSVLVLMNGIHLDDKYHSSPLKFDPWRWQQILENNELYKNPSFMPFGGGLRLCPGMHLAKLELGLFLHHFITKFRWEPLDDDKISYFPVSHLTKGFPIRLHPQEQMDD

SEQ ID NO: 329 - protein, 270 aa, Pinus radiata
MDRLSNGQTTCNSVEKGNDGGLNFDNSISDAVRTKLRQMRDVIEKEDPSSKVTDDDTLRRFLYARELNVEKASVMFSKYRKWRQTFVPLGYIPETMIRDELMKNSVHMQGFDKRGRPIAVIFLARHIPCRKTIENLKCHFVYIFDKMSASSRGQTKFTIIADFDGWTYKNVDIRGAIAVLEILQDYYPERLGKVYLIHRPYIFWAAWKIVSPFIDQVTREKIVFVEDKHLNETLLNDIDESQLPEIYGGKLPLVKIQDCVVPNWPPITST

SEQ ID NO: 330 - protein, 289 aa, Pinus radiata
MTGVEYDASDKDREPFVEVDPTGRYGRYEDVLGRGAMKTVYRAFDQEDGIEVAWNKVSLQNLDDVSLERIYSEVRLLKSLRNGNIIMFYNAWLDRKTGHVNFITEVCTSGTLRQYRQKHRHVSMKAVKNWARQILDGLHYLHSHIPCIIHRDLNCSNIFVNGNTGILKIGDLGLAAALENDHAAHTIIGTPEFMAPELYEEDYNELVDVYSFGMCLLEMVTLEIPYSECRSVAQIYKKVSSGIRPAALEKVTNQEVRQFIEKCLAVTSARPSAAELLKDPFLSEVQSSS

SEQ ID NO: 331 - protein, 879 aa, Pinus radiata
MPYYVLQREVESEFLEVDPTGRYGRYNDVLGKGASKTVYRAFDEIEGIEVAWNQVKVNDILQSPEDLERLYSEVHLLKTLKHKNIIKFFSSWIDTTTRNINFITEMFTSGTLRQYRQKHKRVDLRAVKNWARQILRGLLYLHSHDPPIIHRDLKCDNIFVNGNQGEVKIGDLGLAAILRKSHSAHTVIGTPEFMAPELYDEEYNELVDIYAFGMCLLEMLTFEYPYSECSNPAQIYKKVTSGKKPAALYKLKDPEVRQFVEKCLVTVSRRLPARELLMDPFLQTDEHGLEYSFSRLDFCKDDVGELGPLLREPNIEAFQNGAHKLLQSIHLVHPCSKNEISVHHENKKQQKVVPLPSYIREDSMSHNMDFTVKGKKREDDTIFLRLRIADTEGRIRNIYFPFDVEEDTAMSVASEMVAELDLADQDVTKIAEMIDEEIMALVPDWKAGVAIDDHHSFYDHYHSSNKTSETCWWNHNDHASSISSQSSLLEYLRSHYHVDNKSEIVPCTQVECAAMHGRFEEVTFQFNATDFYSYVEEEAPTISSGSSDVLHHDWVNGEDPVSPISLISHGSGISNFEDPQTCLISSGTGNKEDVVPSKPAKPPETTGYVGNFEESWSNGLSEGFSPVTDSNCLSSVPKPMFHPQSPSSVNILSDEDEDSTSRELRLLAVKHQKELMELQRKHEHSLLGIENELKNRTPLGTSLDMKNSSPGINFQDQKLNVNGQREQREDDSVRHGTTGRDKEFVAMKQLGSDARGTRLSSSPSHRLSPMEPAVSSDLPGPSKLAMHSSTLPSVRPINRNIAPNQRLMKMHSFSGVDSQRSINSLAKEVSRQKNYQTIGAFRTGNVDEKKHSLEGMRRFPSISQKSSSRNCKEGKTKIV

SEQ ID NO: 332 - protein, 487 aa, Pinus radiata
MGSGIMTETLTDSWLVGLLCLVLGFLLLQLYKLVWGASSRAYKLPPGSTGWPLIGETIGFFRGINSTAQPRQFIQERERRYGEIFRSNLFGRSRIVVSVDPEFNKHVLQHEGRQFQANYPKPLRNLIGKYGLLSVHGDLQRKLHGAAVNLLRFERLSVDFMEDIQNLLHITLAKWEAKRDIHLQEECHQLVLNLMAKQLLDLSPSKDTEEICEAFGHFSEALLAVPIKIPGTKYARGFKAREFLIKKIYESIEDRRQHPEAVHNDLLTKLLKEDTFSEEIIADFILFLLFAGHETSSRSMSFAIKFLTDCPRALEELKAEHDALLMRKGNLKNQKLNWDDYQSLKFTQCVIHETLRVGNFGPGVFRETKEDIKTKGGFVIPRGWTVYVFLTGTHLDEKYHSSALKFDPWRWQPHLQDQELLKNPSFMPFGGGARLCPGMHLAKMELALFLHNFVTKFRWEALQDDKISYFPFPRLIKGLPIRLRLRE

SEQ ID NO: 333 - protein, 488 aa, Pinus radiata
MAIMGETLHSLLVGLVCFALGMLLLELYKLVWRVDSRSYKLPPGSTGLPLIGETISFFRGINSTDQPRRYIQEREKRYGEIFRSNLFGRSRIVVSVNPEFNKHVLQHEGRQFQANYPKPLRNLIGKFGLLAVHGDLQKKLHGTAVNLLRFERLSVDFMTDIQNLLHTTLPKWQAKRDIHLQEECHQLVLNLMAKQLMDLSPSKETEEICEAFGHFSEALLAIPLRIPGTAYARGFKAREFLIKRIYEGIEDRRKHPQVVRNDLLTKLLKEDSFSEELIADFILFLLFAGHETSSRSMSFAIKFLTDCPKAYQELKAEHDALLQRKGNRRNGNLTWDDYQSMKFTQCIINETLRLGNFAPGAFREAKEDVKTKGGFVIPKGWTVYVFLTGTHLDEKYHSSALTFNPWRWQQLLQDQELSKNPSFMPFGGGARLCPGMHLAKLELALFLHNFVTKFRWEALQDEKISYFPFPRLIKGLPIRLHPQERLGD

SEQ ID NO: 334 - protein, 577 aa, Pinus radiata
MGGTVVDSVRRWYQRRWSHSSSAHESGKEKQTVDSLSSSSVSPLPVETKAVEGRGLKPVRVQLRSKMTGPDRSRKSSLETEFFTEYGEANRYQIQEVVGKGSYGVVSSAIDTHTDIVEIKHIMLPPSRREFKDIYVVFELMESDLHQVIKANDDLTPEHYQFFLYQLLRALKYIHTANVFHRDLKPKNILANADCKLKICDFGLARVSFNDAPSAIFWTDYVATRWYRAPELCGSFFTKYTPAIDIWSIGCIFAEMLTGKALFPGKNVVHQLDIMTDLLGTPSTETLSRIRNEKARRYLSNMRKKQPTPFSQKFPNVDPLALRLLERMLAFDPKDRPTAEEALADPYFNGLAKVEREPSTQPISKLEFEFERRRLTKDDVRELIYREILEYHPQMLQEYLCGGNNATFMYPSAVDMFKRQFAHLEEHYSKGENSTPLGRQHASLPRERVIEFRENPTKHSKDSEKQQERITASVTKATLQSPPRNQGIVIDSAVSLSNGPSRAVPDPRNLVKSASINASKCTVVVNSCQRRNSTMKPGDEKKEDLSSESSAVTYNTDSMVAGLTSKIAAMSSGVAHS

SEQ ID NO: 335 - protein, 217 aa, Pinus radiata
MAYRADDDYDYLFKVVLIGDSGVGKSNLLSRFTRNEFSLESKSTIGVEFATRSITVDDKVIKAQIWDTAGQERYRAITSAYYRGAVGALLVYDVTRHVTFENVERWLKELRDHTDANIVIMLVGNKADLRHLRAVSIEDGKAFAERENTYFMETSALESTNVENAFTEVLSQIYRIVSKKALDVGEDPAAVPSKGQTIHVGNKDDVTAMKKVGCCSL

SEQ ID NO: 336 - protein, 575 aa, Pinus radiata
MMKKRGDSSSSFPDEVLEHVLLFVVSIKDRSAVSLVCKAWYRAEAWSRRKVFIGNCYSVSPEILVRRFPKITGITLKGKPRFSDFNLVPPHWGADIHPWLLVIRGAYPWLRELRLKRMIVTDESLELIARSFSDFRALSLTTCEGFSTDGLAVIATHCRNLQELDLQESEVDDRGGYWLSCFPESCVSLVSLNFACLQSEVNFDALQRLVARCISLRSLKLNKTLSLEQLKRLLVIAPQLMELGTGSFFQELSGPQFTTDLENAFKNCNKLRTLSGMWEVAPLYLPALYSVCSNLTFLNLSYAANIRSMELGRLVSHCPQLRRLWVLDTVGDKGLETVSSNCKNLRELRVFPLDPFGQDRVGVTEKGILKISQGCPNLSYVLYFCRQMTNAAIIEVAQNCPRLTHFRLCIMNPCQPDHLTDEPMDEAFGAIVKICKGLQRLAISGLLTDKAFEYIGLYAKNLETLSVAFAGSSDLGMECVLRGCPKLRKLEIRDSPFGNAALLSGLEQYESMRSLWMSSCKVTMSGCRYLAQNKPRLNVEIIKENDEDDNDADKLYVYRTIAGPRRDAPNFVLTL

SEQ ID NO: 337 - protein, 221 aa, Pinus radiata
MVDHSLIYSFVSRGTVILAEYTEFTGNFPTIAFQCLQKLPATSNKFTFDCQHHTFNYLVEDGFTYCVVADESAGRQVPMAFLERIKDEFKKTYSDGRAEVAIANGLHQEFGPKLKEHMDYCAQHPEQINKLAKTKAQVAEVKGVMMDNIEKILDRGEKIELMVDKTEQLQFQAQDFQNQGAKIRRKMWFRNTKVKLICLSFLLFVVLMIWISLCRGFKCHV

SEQ ID NO: 338 - protein, 220 aa, Pinus radiata
MAILYALVARGSTVLAEFDAAHGNAKTIARQILEKIPGTGDSHVSYSQDRYIFHVKRTDGLTVLCMADDTAGRRIPFAFLEDIHGKFVKTYGRAVHTALAFTMNDEFSRVLSQQMEYYSSDPNADKINRIRGEMSQVRNVMVENIDKVLERGDRLELLVDKTETIQGNTFKFKKQARRFKNTMWWRNIKLTVAVIVVLLIVIYVILAIVCKGVTLPSCRK

SEQ ID NO: 339 - protein, 377 aa, Pinus radiata
MAVVASNSLQLQREEEAETMISDQQQEAGAEIMASEEESIMEPENPSLSHPNIVSSCGMRFQKYQSVWIDANLVPAVNFIQNEFQPRPDDIFFASLPKTGTTWGKALLYTILEFTSTGNNPPASPNGNSAADEKRFGVDEKNPHALVPTMETYLFNSSDSEQYDISCFSDFPSPRVLHTHLPIHTLPLLVRSSPTCKIVYIARNPRDSFVSLWQFYARLRGAGSHYLDGDLGKETVFDAFCSGFYYGGPFAENVLSYWHESRRNPNQVMFVTYEDLQADCVGWVKRMALFLGCSSPLLEDNAQIIAEKCSFDTLCNLQVNRKGKVGTLKYGMKNAFFFREGKVGEWKKHFTPQMEERIYLEIEQKLSDQGLRFTNSL

SEQ ID NO: 340 - protein, 220 aa, Pinus radiata
MGQQSLIYSFVARGTVVLAEYTQFTGNFTTIANQCLQKIPASNNKFTYNCDRHTFNYLVEDGYTYCVVADESVGRQLPIAFLERIKDDFKKRYGGGKADTAVAHSLNKDFGPKLKDHMQYCVDHPEEINKLAKVKAQVSEVKGVMMENIEKVLDRGEKIELLVDKTENLRFQAQDFQKQGTQLRRKMWFQNMKVKLVVLGIVFVLILIIWLSICHGFKCH

SEQ ID NO: 341 - protein, 513 aa, Pinus radiata
MENMRKKLGPLFNSGQSFRPDISVDSCTSYKVTAGGTLHLLSNSCGEYNINELGLQKRTSAGIDEYDTNEKTYQCASHEMCIFGVIGRGASSVVQKAIHIPTHRILALKKINTFEKEKRHQLLNEIRTLCEAPHVKGLVEFHGAFYTPASGQISIALEYMDGGSLRDLVQSKKRIPEPILSVITHEILHGLIFLHHVRHLVHRDIKPANLLINLNGEPKITDFGISVGLENTVAMCGTFVGTVTYMSPERIGNEYYSFPADIWSLGLSIFECGTGEFPYNASKGPVNLMLQVIDDPSPSPSRDCFSEEFCSFVDVCLQKDPTARPTAEQLLSHPFIKKYENAGVDLSAYVQSIFDPIDRLKDLADMLTVHYYMLFDGTDDQWHHMKTMYRENSAFSYANQVAAGANDIFNTLSRIHSMLVGDSPDERLVHVVENLQCCVYGQHGVVIRVSGSFVLGGQFIPTGGGVQVEGVSQGPLLDIASQRMGTFNEQFIMEPGEQIGCYYIYKQELCIQQ

SEQ ID NO: 342 - protein, 370 aa, Pinus radiata
MAQTAQPALDPNIPGVLTHGGRFVQYNIYGNMFEVTAKYVPPLFPIGRGAYGVVCSALNSETNEQVALKKISNAFDNLIDARRTLREIKLLRHMQHENVISIKDIMLPPQREAFDDVYIALELMDTDLHQIIRSNQALSEQHCQYFLYQILRGLKYIHSANVLHRDLKPSNLLLSANCDLKIADFGLARTTSETDFMTEYVVTRWYRAPELLLNSPDYTAAIDVWSVGCIFMELMNRKPLFPGKDHVHQLRLITELTGTPTDADLGFIRSENAKRLVQLLPQLPRQSLAEKFPHVHPSAIDICERMLTFDPNQRITVEEALNHPYLGSLHDETDEPTCPVPFNFDFEQYALTEEQMRELIYMEALAFNPT

SEQ ID NO: 343 - protein, 647 aa, Pinus radiata
MKRCEGCFEVGRLEALGDDILLQVLDNINETRDRNSWSLVCKQFYRLESAYKRKIRLLRGEMLPRILKRYRAVEHLDLSLCPQISDQCLGFVAAAAGSSLRSIDLSRLVRFSHLGLSVLAKGCENLVEIDVSYCARFGDMEAAAVSSAKNLQTLKLVRCQMVSDLGLSLIAVGCRKLQNLNLKWCVGVSDLGVELVAIKCKELRSLDVSYLQITNKCIASITQLFYLETFVSVGCVCIDDEGLALLKNGCKSLQRLDVSKCQSMSSTGIISLANGCIALQQLNLAYCIPVTNALLASFDKYDSLQSIRFDGCEISSSGLKSIGKSCKSLMELSLSKCTGVTDEGISALVGGCTGLKILDITCCRDLTDVAITAVATSCGNLSCLKMESCALVTERSLYMLGDSCPFLEVLDLTDCSVSNTGLKSISRCTGLTTLKLGLCENISNEGLTHIAAHCSNLQEIDLYRSVGIGDTGLAALASGCPKLRMVNLSYCIGITDHGLKSLAQLEKLYNLEIRGCFLVTSAGISAIASGCKRLVELDIKRCYRVDDMGMMTVVQCCINLRQINVSYCPISDAAFLALVNLSCLQNVNLVHLRNVSLDAFAYLLLACESLKKIKLLKQLKSLLSSNLIRHVENKGCRIRWVEKPLFI

SEQ ID NO: 344 - protein, 390 aa, Pinus radiata
MEAAAAPVQSTDTLMSDAPQAAGSNPMDSIPAVLSHGGRFVQYNIFGNIFEVTAKYKPPLLPIGKGAYGIVCSAMNSETKEQVAIKKIANAFDNRIDAKRTLREIKLLRHMDHENVVAIRDIIPPPQREAFDDVYIAYELMDTDLHQIIRSNQGLSEEHCQYFLYQILRGLKYIHSANVLHRDLKPSNLLLNANCDLKICDFGLARITSETDFMTEYVVTRWYRAPELLLNSADYTAAIDVWSVGCIFMELMNRQPLFPGRDHVHQLRLLTELIGTPTEADLGFVRSDNARRFIRQLPQYPRQSFTQKFPHVHALAIDLCEKMLTFDPNQRITVEEALAHPYLANLHDISDEPICAMPFSFDFEQHTLTEDQMKELIYREALVFNPEYAQ

SEQ ID NO: 345 - protein, 462 aa, Pinus radiata
MAKKQAGKSNDSTVNDSGSENETKKPAGSKEDGSIHSPLVAYASILSLLSCTPPFVIFLWYTMVHLDGSASQFWDLCKEQGLQGFLRIWPKPTLIAWKLIASFAAFEAALQLLLPGERVTGPVSPAGNIPVYKANGVLAYFVTLTTYIAIWWFGLFNPAIVYDHLGEIFSALIIGSFIFCIFLYIKGHVAPSSTDSGSSGNVVIDFYWGMELYPRIGKNFDIKVFTNCRFGMMSWAVLAVTYSIKQYEEYGRVADSMLVSSILMVVYVTKFFLWESGYWNTMDIAHDRAGFYICWGCLVWVPSVYTSPAMYLVRHPISLGLKLSLGILIAGIACIFINYDCDRQRQLFRKTNGNCLIWGRPPSKIEAWYETMSGEKKSSLLLTSGWWSVSRHFHYVPEILAAFFWTLPGLFNHFLPYFYVIFLTILLFDRAQRDDQRCRAKYGKYWDIYCKQVKYNIIPGIY

SEQ ID NO: 346 - protein, 562 aa, Pinus radiata
MKFPAPARNLLIVLIVFLERILTRCMVSDSSNHEPPSSCTATRISPASSGIISNTKPADCSSLASLDLHGSISLPGTAITTEDFGGIYHHKPLAIVHPASVEDIVKVVTMVNASPNLTLAAMGNGHSINGQAQALNGLVLDMRSLKGIEIFQGSPTEGPYVDACGDELWIDVLKATLRVGLAPRSWTDYLPLSVGGTLSNGGVSGQTFKFGPQISNVLNLHVVSGKGESMTCYPETNQDLFYGALGGLGQFGIITKARIMLQRAPHMVRWIRAVYADFEEFRADQELLISLPEEGTFDYVEGFVLTNNDDPINGWPSVLLSPSNSSFDFKLIPQTAGPMLYCLEVALHYDHDEDFVTLNKRIESMLAPLRFIKGLHFSFDLPYFDFLNRVHAAEVAARSSGIWDAPHPWLNLFVPKSKISAFDAKVFREILKDGVGGPILVYPVTRNKWDSRMSAIIPEEDTFYLVALLRFSPPYPSGPPIQSILAQNEQILHYCTTAGIDMKLYLPHYKTESDWKRHFGRKWQQFLQRKSKYDPKAILAPGQRIFSRSTDSTAFTRLYSSS

SEQ ID NO: 347 - protein, 314 aa, Pinus radiata
MAGELTQAEKETLAAVNVGASALSFAGSAFIVLCYVLFRELRKFSFKLIFYLALSDMFCSLFNILGDPGKGFFCYAQGYTTHFVCVASFLWTTTIAFTLHRTVVRHKTDVEELGAIFHLYVWGTSLVMTIIPSIGDGYGQAGAWCLVKTTSRATKVLQFITFYAPLWGAILFNGFTYFQVSRMLNNATQMAAGMSDRQQQTDSRVDMKAMNRWGYYPLILIGSWTFATVNRIHDFIEPQEKVFWLSFLDVGTAALMGLFNSIAYGLNASVRRTLQQKIDLWWPEWFRKWLPGFIMLRDQAHESEMISLKIPVEQ

SEQ ID NO: 348 - protein, 215 aa, Pinus radiata
MAYKADDDYDYLFKVVLIGDSGVGKSNLLSRFTRNEFSLESKSTIGVEFATRSIIVDGKTIKAQIWDTAGQERYRAITSAYYRGAVGALLVYDITRHTTFESVERWLKELQDHTDNNIVVMLVGNKADLRHLRAVSTEDSQALAERESLYFMETSALESTNVENAFTQVLTQIYRIVVKKALDVSEEPSALPPQGQAINIKDDVTATKKPMCCNF

SEQ ID NO: 349 - protein, 746 aa, Pinus radiata
MESCNCIDPPWSADDLLTKYQYISDFFIALAYFSIPLELIYFVKKSAVFPYRWVLVQFGAFIVLCGATHMINLWTFHVHTKAVAMVMTISKILTAVVSCATALMLVHIIPDLLSVKTRELFLKNKAAELDREMGIIRTQEETGRHVRMLTHEIRSTLDRHTILNTTLVELGRTLALEECALWMPTRTGLELQLSHTLRQQNPMTFTVPIQHPSINQVFSTNRAVMISPNSPVAMIRPRTGKYMIGDVVAVRVPLLHLSNFQINDWPEPSKRWYALMVLMLPSDSARRWHVHELELVEVVADQVAVALSHAAILEESMRARDLLMEQNVALEIARQEAETAIRARNDFLAVMNHEMRTPMHAIIALSSLLQETELTPEQRSMVETILRSSNLLATLINDVLDLSKLEDGSLELNIRIFNLRSMFREVHNLVKPIASVKKLCVSMNLASDLPEYAAGDDKRLMQTVLNVLGNAVKFSKEGSVSVTVLLERPECLRDPRAEFYPVQGDRHFYLRVQVKDTGAGINPPDIPKLFSKFVHSDTMTTRNYGGTGLGLAICKRFVNLMEGHIWLESEGLGKGSTCIFIVKLGIPDPIHEMEHQYVFPIPSNSTRKDFPGLKVLVTDDNGVNRMVTRSLLARLGCDVTVVDSGHECLQAMSQAGQNFKVLFLDVCMPGMDGYEVAIHIQEMFPNRHERPLLVALTGSADKATKEKCIKIGMDGVLLKPVSLEKMRSVLVDLLEHGSVCDSIQRL

SEQ ID NO: 350 - protein, 206 aa, Pinus radiata
MSFRKRALFKVIVLGDSGVGKTSLVTQYVHKRFSSQYKATIGADFMSKELQVDDRLVTLQIWDTAGQERFQSLGVAFYRGADCCVLVYDVNVLKSFDNLENWHKEFLNQASPTEPDTFPFMLLGNKIDVDGGNSRVVSELKAMTWCKSKGIPYFETSAKDDYRIDAAFLSIARSALKNQPEQEIYFLGLPEALPESEPPSRSFCGC

SEQ ID NO: 351 - protein, 574 aa, Pinus radiata
MVVRRMSSFPDELLEHVLAFLSSHRDRNAVSLVCKSWFRIEAGSRQRVFIGNCYAVSPAILIRRFPRIKSVALKGKPHFADFNMVPPGWGADIHPWLAAMAEAYPWLEELRLKRMVITDESLQLLARSFPNFKVLVLTSCDGFSTDGLAAIAAHCRHITELDLQESDIDDRGGNWLSCFPDSCTSLVSLNFACLTKEVNFEALERLVARCTSLRSLKLNRLVPLELLHRLLVRAPHLEDLGTGAFLHEPRTEQYSKLKVALQNCKRLQSLSGFWEVAPGYLPLVESLCSNLTSLNLSYATIQSAELTNLLGHCHKLQRLWVLDYIEDKGLEVVASTCKDLQELRVFPLDPYGQGAVTEEGLVTISRGCPKLTSVLYFCCQMTNAALITVARNSPLLTCFRLCIFDPTSPDHLTKQPLDEGFGTVVQSCKSLRRLSMSGLLTDKVFQVIGTYGKCLEMLSVAFAGDSDFGMQCVLSGCINLRKLEVRDSPFGDLALLAGSEKYESMRSLWMSSCSVTVHGCKELAAKMRNLNVEVIHDRDQFEDISTMTQPVDGLYVYRSVAGHRKDTPHFIYTM

SEQ ID NO: 352 - protein, 219 aa, Pinus radiata
MAQQSLIYSFVARGNIVLAEHTSFSGNFSIIAVQCLQKLPSNSNKFTYTCDNHTFNYLVDDGFVFLVVADEAAGRQVPFIFLERVKEDFKRRYGGRAETSMAHSLDKDYGPILRDHMQYCMDHPEELSKFFKIKAQVSEVKGIMMDNIEKVLDRGEKIELLVDKTEGLQFQADNFQRQGRQLRRKMWLQNLKFKLIVLGIVLVIMLIIWLSICKGFSCH

SEQ ID NO: 353 - protein, 346 aa, Pinus radiata
MSIISIPEVEVEMGSASPNARTLRATVVQASTVFYDTPATLDKAERLIAEGAAYGSQLLVFPEAFIGGYPRGSNFGAVIGNRTFKGREEFRKYHASAIDVPGPEVERISAAAAKYKVHVIMGVIERAGFTLYCTVLFFDSQGRFLGKHRKLMPTSLERVIWGFGDGSTLPVYDTSIGRVGALICWENRMPLLRTALYGKGVELYCAPTADARESWQASMLHIALEGGCFVLSANQFCRRKDYPPPPDYVFGGSEENMSPESVVCAGGSVIISPTGTVLAGPNFEGEALITADLDFGEIVRAKFDFDVVGHYARPEVLKLTVNDYPLNPVTFSSGIAASEKKDSENV

SEQ ID NO: 354 - protein, 217 aa, Pinus radiata
MEDDPGEDYLFKVVLIGDSAVGKSNLLSRYARNEFHMNSKATIGVEFQTQSMEFDGKEIKAQIWDTAGQERFRAVTSAYYRGAVGALVVYDISRRHTFESVGRWLDELKMHSDMNVVTMLVGNKCDLESLREVPVEESKALAEAEKLFFIETSALNATNVNDAFQIVIKEVYNNMSRKALNSGSYKSKLLSNGSTSVNLVQNGDAATKTGLKKYGCC

SEQ ID NO: 355 - protein, 330 aa, Pinus radiata
MAVPVIDIKKLLDGEEREMTMDQIHKACQEWGFFQLVNHGIPYSLLDRVKVLFKEHYKNSMDAQFQDSAVVQMLESSNSQGMNLSATKIDADWETGFFLPLSSHKTETVTPPLPANFRETMEEFAEEVKGLAERLLEIMCENLGLEKVYLKEALAGGNGDNNSPFFGIKMSHYPPCPRPDLIDGLRNHTDAGGLILLLQDDEIDGLQVLMDGTWFDVQPIQHAIVIDIGDQLEVMTNGKYKSMWHRVLAKEDATRMSVAAFYNPSSDAEVYPASQLMSAEQNGSNNVNAESGYDYPKFVSADYMTVYAAQKFLPKEPRFEAMRSVGHAVN

SEQ ID NO: 356 - protein, 368 aa, Pinus radiata
MATKVDPPNGVAAEGKHYYSMWRNTFEIDTKYIPIKPIGKGAYGIVCSAKNTETNEKVAIKKIGNVFENRIDAMRTLREIKLLRQLAHDNIITLKDIMTPVGRSNFRDVYLVYDLMDTDLHQIIKSSQALTDDHYQYFIYQLLRGLKYLHSANVLHRDLKPSNLLLTANCDLKICDFGLARTNCETGQFMTEYVVTRWYRAPELLLSCDEYGPSIDVWSVGCILAELLGRQPIFPGKDYINQLKLIINVIGSPAEDDLYFVQSQKACSYIKSLPHVPSASLQRLYPQANPTAIDLLDKMLVFDPYKRITVTEALEHPYFSALHDPRLEPSATAPFELDMPDEELRVQELREMVWKEMLYYHPEAANIL

SEQ ID NO: 357 - protein, 481 aa, Pinus radiata
MGIELEMDRPQEEGWVRGAILGAGAYGTVSLGVSRSNGQLFAIKSAAGFSVALENEYQILRCLDCPYIVRCLGHNYSFENGAEVHNLFLEYMPGGSLVDLLGRFGGTLNETVIRAYTRGILRGLDYLHSQGIVHCDIKGKNILVDSNGVKLADFGSAKRVDDEEKCEEAMQLRGTPQWMAPEVVNQVEQGPASDIWSLACTVLEMATGRPPWSHVSSPLAAMYRIGCTEELPGLPGCLSPQIRDFLEKCFRRDPKKRWSSAELLNHPFLKKDCSVIEAEEAIRGPGSPTSHLDFRNHIWDSYCSQTTLIPSLSLPSPTRERNAEVNRSVEQCPRRSPRDRLMALAAACKFEKVANRPNWITSLHGPWTVVKSSRSKSPTSDKPLLKSDISNGSSIQELPFTEERCSTSFKAVNWKGLQPRGELDQCSQAMLSSAQSQHQPSSSTSSKTPHHNLFSLAETSNLTGEAWESDGNSSQRIVGGD

SEQ ID NO: 358 - protein, 318 aa, Pinus radiata
MSGRRNPLLNIPIPARQQTQLYRLPLPPQSTSVSRDVSDLADLERIQILGHGSEGNVYKVRHRRTSELYALKVIHGNHDETVRQQIIRQMEILKKTESPYVVKCHGIFERGEEIHFVLEYMDGGSLEQRRSDTMSERFLAEVARQVLEGLKYLHRHKIVHRDIKPSNLLINRRQEVKIADFGVSRILSQTLDPCNTYVGTCAYMSPERFDPETYGGRYDGYAGDIWSLGLSLLECYTGHFPFLAAGQKADWPALMCAICYGDPPAPPPTASAHFRSFITCCLHKDARNRWTAAQLLGHPFVLSNPPQTPSIPMQRLSI

SEQ ID NO: 359 - protein, 368 aa, Pinus radiata
MATRVNPPNGVFVEGKHYYSMWRNIFELDAKYIPIKPIGKGAYGIVCSARNAETNEKIAIKKIINAFENQTDARRTLREIKLLRLFAHDNIIALKDIMTPVTRTNFNDVYLVYDLMDTDLHQIIKSSQVLTDDHCQYFIYQLLRGLKYLHSANVLHRDLKPSNLLLNANCDLKICDFGLARTNCEKGQFMTEYVVTRWYRAPELLLSCEEYGTSIDIWSVGCIFAELLGRKPIFPGKDYINQLKLIVNVLGSPDEDDLEFIESQKARSYIKSLPVTSHASVQRLYPRANPSAISLLDKMLAFDPRKRITVTEALEHPYFSALHDPSLERSATAPFDLDMPEEELKEEELKEMFWNEMLHYHPEAANTS

SEQ ID NO: 360 - protein, 600 aa, Pinus radiata
MRQEHSENPEEEEERVSFDLNSMCKFSSQSDTEPIETSFPDEVLEHVLVFLTAHKDRNAVSLVCKSWYRVEAWTRHQVFIGNCYALSPGTMINRFPKIKSVTLKGKPRFADFNLVPPNWGAHLHPWVLAMAPAYPWLEKLLLKRMTVTDEDLALLADSFPNFKDLVLLYCDGFSTKGLGIIASKCRQLRRLDLNEDDIVDSGVDWLSCFPETTTTLECLSFECLEGPINIDALERLVARCLSLKELRLNRTISIVQLHRLMLRAPQLTHLGTGCFSYDFIPEQATVLQVAFNNCKSLQCLSGFREVVPEYLPTIYSVCNNLLELNLSYAVMGSRELEQIVCNCPKLQRLWVLDSVEDAGLRAAAATCKDLRDLRVFPMDAREDGNGCVSDEGLVAISEGCPNLQSILYFCQRMTNAAVVTMSKNCQNLTSFRLCIMGRHKPDHITHKPMDEGFGAIVMNCKKLTRLAVSGLLTNKAFEYIGTYGESLETLSVAFAGENDLGMKYVLDGCRRLRKLEIRDSPFGDTALLSGLHHYEQMRFLWMSDCKVSIQGCMELARKMPWLNVEIIRENSYDDRLVEKLYVYRSVAGPRKDMPPIVITL

SEQ ID NO: 361 - protein, 256 aa, Pinus radiata
MGSSSHRENGAVKAVSCSKEDKLEQSRVNLMRSIVEAKDSSAKATDDATLRRFLRARDLNVGKASELFLKYLKWKRAFVPLGYIPESEVSNELRKNKIFIQGLDKQRRPIGVILAARHNAFDRDLEEFKRLVVYGFDKICACMPRGQEKFVMLADLEGWGYKNVDIRAYLMVLEIMQDCYPERLGKLFMIHVPYLFWAAWKTVYPFIDKVTKKKIVFVEDKHLKETLLNDIDESQLPEIFGGKLPLVPTQDCVIPN

SEQ ID NO: 362 - protein, 216 aa, Pinus radiata
MENVGGEEYLFKIVVIGDSAVGKSNLLSRYARNEFNANSKATIGVEFQTQVMDIDGKEVKAQIWDTAGQERFRAVTSAYYRGAVGALIVYDISRRLTFDNVARWLEELKMHADGNVVKMLVGNKSDLAHIREVPVEDGKKLAESEGLFFIETSALDNTNVLPAFQIVVKEIYTNVSKKMLNSDSYKSQLSLNRVNITDAYGDGDGVDPPKTKNSCC

SEQ ID NO: 363 - protein, 489 aa, Pinus radiata
MGHAASVVIPPQETKQEDEDSQEGVDYTLNIPDECLAHVFHYLKPGDRKPCSLVCKRWHHAEGQSRRRLSLDARAEIVPAIPSLFWRFNYVSRLALRGNRRTIGINDDGLLLIGIHCKNLKNLKLRSCREITDIGMSRFAQLCGSLRKFSCGSCTFGTPGINAITTHCKSLEELTVKRLRSAGEVPSEPVGPGAGNLKRICLKELYYGQFFVPLIAGSKKLQTLKLSKCSGDWDTLLDIITQDVTSLVEVLLERLHVSDTGLLAVSKLASLEILHLAKTPECSNTGLAAIANGCRKLRKLHVDGWRTNRIGDEGLIEIARKCHYLKELVLIGVNPTITSLSMLASNCHVLERLALCGSATIGDAELSCIAAKCYSLKKLCIKGCPVSDQGMESLISGCPMLVKVKVKRCRGVTSEGADLLRANKGSLDVSLDTITSPSLNGLSTQASSSVPRASAISSAGKSTLSKARLTLIAGGSFLACAFLKLSNGS

SEQ ID NO: 364 - protein, 497 aa, Pinus radiata
MAGLDNGVVNGIVSVKFTKLFIDGKFVDAISGKTFETLDPRTGDLITRVAEGDKEDVDLAVKTAREAFDKGPWPRMSGYERGRLLNRYADLVEQYIDELAALETLDNGQPLTLVRVIVTGCIQILRYYAGAADKIHGETLKMGGQYQAYTLHEPIGVVGQIIPWNFPLFMFFMKISPALACGCTIVIKPAEQTPLTALYCAHLAKEAGLPPGVLNVITGFGETAGAAISNHMDIDKVAFTGSTDIGRVIMVAAAHSNLKPVTLELGGKSPLIIMDDADIEEAVNLAHKAIFFGSGQVCCAGSRIYVQEGIHDKFVKRVVERAKKQVVGDPFNPEVDHGPQIDKTQFEKILEYIEHGKREGAKLLTGGSRVGEKGFYIEPTIFSHVQEDMKIGKEEIFGPVVSIFKFRTIEEAIELGNKTIYGLAAGIVSKNIDTVNRLSRSIRAGVIWVNCYHVVFPDAPFGGYKMSGIGREQGLDVLKNYLAVKCVITPLHDSPWL

SEQ ID NO: 365 - protein, 349 aa, Pinus radiata
MRKKDLKKLKLAVPAPETPMSDFLTASGTFQDGDLLLNRQGLRLISQEDDESPSPIEPLDNQFTLADLETVSVIGKGSGGVVQLVRHKWTGQFFALKAIQMSIQESVRKQIVQELKINQASQCPNVVVCYHAFYNNGVISIVLEYMDCGSLADVIKRVKTFTEPYLAVICKQVLKGLIYLHRDRHIIHRDIKPSNLLVNHKGEVKITDFGVSATLANSMGQRDTFVGTYNYMSPERISGSTYGFSSDIWSLGLVVLECATGRFTYLPPGQEEGWLNFYELLETIVEQPAPCASPDEFSPEFCSFISACVQKDPKDRMSATDLLNHAFIRKYEDQNVDLAALLSSLSSPV

SEQ ID NO: 366 - protein, 919 aa, Pinus radiata
MALMMEFGDDAGIGEEWEDNESQRMEIDTGKGIETHFNDIPEVIMSNIFSAIKDTRSRNRMALVCRKWHEMERATRVYLCIRGNISNNLYRLPMCFQSVTKLDLSLCSPWGYPPLDFTTPHGNFIGHRLKQAFPRVNNIVIYVRSARNIEKLSSLWPCLEHVKLVRWHRRAMDPESAVGLGMELKLLMQNCTALKSLDLSQFYCWTEDIPLALQAEPHVSANLSSLNLLKLSAEGFRAQELAAISGACRNLEELLAVCVFDPRYMDCVGDEALVVLARNCSRVRILHLVDATAFEALRGDPEDIFSSENAKITRQGLESMFWNLPLLEDLVLDISHNVADSGPALEFLSSHCKNIKSLKLGQFQGICKGPEPDGVALCTNLEALFIKNCSDLTDTGLAAIAAGCSRLGKLELQGCRQITEAGLKFCTSRLSKTLVEVRVSCCKYLDTAATLRALEPICESVRKLHIDCIWDKSILDQEIASPSRRLNPVGSSAISTREIASYGMGKNHLVSAGDCNVNRWDQNPESAWGPSLQLAPPQFCPDLNCANFDFGSSPSDVPMTNWGLDLNLTASSCSGPLESSEERGCLPIENFFEEHEKPNSLGSDRYVPSDGVMFRGMDVNGKAPQMERLCHSNTGTVSDSSSTEFVDFLGINDKHQEWQKLGADINYGMEVMVNSSQIWGVTGEASKRTSSANLEGEQSWTEIPNQYSYSDSSSHIRSITWKNLQFLSLWIPVGELLSPLAAMGLKVCPLLEEISIQVEGDCRLCPKPRERACGLSSLACYPSLSKLELNCGEVIGFALSAPAGKMDLSLWERWYLNGLRELHLSELNYWPPQDKDMNRRGLSLPAAGLLSECAALRKLFVHGTCHEHFMMMFIRIPDLRDIQLREDYYPAHEDDTSTEMRTDSCRRFEEALASRGFTD

SEQ ID NO: 367 - protein, 573 aa, Pinus radiata
MQQDQRRKAPTEVEFFTEYGEASRYKIQEVIGKGSYGVVCSAIDTHTGEKVAIKKINDIFEHISDATRILREIKLLRLLRHPDIVEIKHIMLPPSRREFKDIYVVFELMESDLHQVIKANDDLTPEHYQFFLYQLLRALKYIHTANVYHRDLKPKNVLANADCKLKICDFGLARVAFNDMPTTIFWTDYVATRWYRAPELCGSFFSKYTPAIDIWSIGCIFAEILTGKPLFPGKNVVHQLDLITDLFGTPPIEAISRVRNEKARRYLSSMRKKQPVPLSQKFSTADPLALKLLERLLSFDPKDRPTAEEALADPYFKGLAKVEREPSAQQISKMEFEFERRRVTKEDVRELIFREILEYHPQMLKEYLNGSDRSNFMYPSAVDQFKKQFSHLEEHYGKGAPVVPLERQHASLPRSSVVHSNTMPPLPEKTISGPSRDRTSESRDESSRYIRETEKLQHDRSAGNALKAPLQPPQKILQGGAAKPGKVVGPLPYENGSTKEVYDPRRLIRNAVLTTSQYAAPIYSYPRRTSNTKIEPNEKEDAESTLMPPKAQYVGIGAARKVAAVQSASSRLY

SEQ ID NO: 368 - protein, 572 aa, Pinus radiata
MGPCNGRFSALILISMTPPPSRVGVLISLFIMSLLLCISAPCMHSPAAALIGLSRSEKYNTDGQDPCRLSFLDTAAAAIDFGRIYHHNPAAILRPVSAEEIARFLRAIYASRALATGYRQEYLTVAAKGAGHSIHGQAQAPDGLVIEMSSLRGVRIHVADRAGGYSYADVAAGELWVDLLAEAMKLGLAPRSWTDYLYLSVGGTLSNAGISGQTFRHGPQISNVLQLDIITGTGELVTCSPAENADLFYASMGGLGQFGIITRARIILEPAPQKVKWVRALYSDFEQFTRDQELLVSMDDGAASVDYLEGFVVVNNEAMRSWSISFRTDTPLDDSVFNDAGTEILFCIEIAKYFTQSDDETADVDKVTGRIISRLSFIPGLIYSVEVPYADFLNRVRVEELNLRSRGLWDVPHPWLNMFVPRRQIQRFTTSLLRIMSPDTVKGPILVYPVKRSKWNTNMSAVIPEDKDEIFYAVGVLRSADPLCLAGSSCLNDLLSQNQQIIDVSTNANEIGNDKTEPGMGAKQYLAHHSQQWQWKNHFGSKWGIFLQRKARYDPLNILAPGQRILNRNHRE

SEQ ID NO: 369 - protein, 585 aa, Pinus radiata; identical to SEQ ID NO: 323

SEQ ID NO: 370 - protein, 341 aa, Pinus radiata
MASTPVSSSASQPNLLRHYTPTVTDCSSSGSSIPVVDLSAQKTSVVQALVKACEDYGFFKVVNHGISQVLIDAMEAEAEKLFALPLSEKERAGPADPYGYGNRSIGRNGDVGWIEYLLFRSDFQYVQQRYKAISPDNYINFCNTASKYISATKKLACDILELLAEGLGLPENIFSSFLTAEGSDSAFRLNHYPPCPDPSNIIGFGEHTDPQILTVLHSNDVGGLQVLSRDGKWVTVSPDPSSFSINIGDCMQVLTNGRFKSVRHRAVTNTLRSRISMMFFGAPALDATIVTPSQLVDEDRPAQYMPFLWSQYKKSIYCLKLGQTRGLLQKFQASMVGVGVA

SEQ ID NO: 371 - protein, 258 aa, Pinus radiata
MGSSGRHENEAEKVVSCYEGDTIEQNRVDLMRSIIEVKYPSAKVTDDATLRRFLRARDLNVEKASQLFLKYLKWRQALVPLGYIPESEVSNELRKKKVYIQGFDKQRRPIEVILTARHYASDRDLEEFKRLIVYGFDKLCASMPTGLETFVVIADFEGWGYSNMDTRAYLAALEILQDCYPERLAKAFMIHVPYLFQTAWKMISPFIDKVTKKKIIFVEDKHLRSTLLNDIDESQLPEIYGGALPLVPAQDFVIPNWS

SEQ ID NO: 372 - protein, 323 aa, Pinus radiata
MAIPVIEMGSLIGNDKERFMAEMGKACEEVGFFQLKGHGIPVELMERVKKVCSEHYNHVREPKFKTESVPVKLLNKSLMEAELSSSEPKKVENVDWEDCIVLQYAQEDYPWPSDPSEFKETMMEFGKEITKLAESLLELLSEILGLEKGYLKRTLSGGDGPDDKAFFGTKISHYPPCPRPDLVEGLRAHTDAGGLILLFQDDEVGGLQVLDNTGRWIDAPPMKDTLVIDIGDQLEAISNGRYRSAWHRVLATDSGNRMSVASFYNPSLDAVISPAPELLSQPKKGSELSLYPKFMFGDYMNVYAQQKFLPKEPRFQAVAALQY

SEQ ID NO: 373 - protein, 468 aa, Pinus radiata
MMEALPDQVVWEVLDRIKETRDRNTAALLCKRFYQIEKNQREYLRVGCGLSPAIEALSALCMRFPNLVRVEIGYSGWMSKLGKQLDNEGLKILSQHCPNLTDLTLSFCTFITDGGLGYLGSCTGLKALRLNFTPGITGCGILSVVVGCKKLSTLHLTRCLNVSSVEWLEYLGRLESLEDLAINNCRAIGEGDLAKLGYGWRNLKRLQFEVDANYRYMKVYGRLAVERWQKQWVACEALEDLSLVNCLISPGRGLACVLRKCQALQNLHLDMCVGVRDDDLISLAQQCPKLKTLSLRVPSDFSVPILMSNPLRLTDESLKAIAQNCSELESVSISFSDGDFPSSSSFSLAGIVSLIEACPIRVLVLDHVYSFNDSGMEALCAAHFLEILELIQCQEVTDEGLQLVKHFPCLSVMRLCRCLGLTDIGLKPLVASHKLQKLKVEDCPQISEKGTQGAAKVVSYKQDLSWIY

SEQ ID NO: 374 - protein, 594 aa, Pinus radiata
MDPMERAAKVLGSSPGHKNMMGCSSSGVKVEPEIDGLLANAGYTVKASDLAHVAQRLEQLESIMGTVQDPGISHLASEAVHYNPSDLAGWIESMFGELNPGADMPVPFGDRGSLIDSSQVHKPIQDDPSLSAMDLALIHEYGLQFNGSQASNPQGFSPDSDPSVRCNIFSGPPLRSGDSTTHTNFQARSFSAQSSDEGSSLSTTRLGTAQQSIDNGAQESGIRVVHLLMGCAEAIQRNNLKVASNLVREIRMTVNSAPCGAMGKVASHFVEALARRICGLNGAESNMSQADAQSEILYHHFYEVCPYLKFAHFTANQAILEAFEGHGSVHVIDLNLMHGLQWPALIQALALRPGGPPLLRLTAIGPRQPDGRDVLQEIGMKLAQFAESVNVEFDFRGVMADKLEDIKPWMFQVKPGEVVAVNSVLQLHRLLYIDAPTGSSPIDVVLKSIGSLRPKIVTVVEHEANHNGPVFLDRFVEALHYYSTMFDSLEACNVLPNSMEKFLAELYIQKEICNIVACEGRYRIERHETLSHWRIRLGRAGFRPSHLGSNAFKQARMLLTLFSGEGYTVEENNGSLTLGWHSRPLIAASAWQGS

SEQ ID NO: 375 - protein, 1132 aa, Pinus radiata
MASNSRYTQSQSTGSNNRRSSTNTNTTTNKATAMAQYNADARLLQVFEQSGESGKSFDYTRSVKSTTESVPEQQITAYLSRIQRGGRIQPFGCVLAVEETTFRIIAYSENAVEMLDLAPQSVPSMEQPQQDVLTIGTDVRTLFTAASAHSLEKAAVAQEISLMNPIWVHCKNSRKPFYAIVHRIDVGMVIDLEPLRTGDAFMSAAGAVQSQKLAVRAISRLQSLPCGDVGLLCDSVVENVRELIGYDRVMVYKFHEDEHGEVVAEIRRSDLEPYLGLHYPATDIPQASRFLFMQNRVRMICDCMATPVKVIQSEELMQPLCLVGSTLRAPHGCHAQYMANMGSIASLVMAVIINGNDEEGGGSGRNSMKLWGLVVCHHTSPRAVPFPLRYACEFLMQALGLQLNMELQLAAQLTEKHILKTQTLLCDMLLRDAPMGIVTQSPSIMDLVKCDGAALYYGGMCWMLGVTPTEAQIKDIADWLLEHHGDSTGLSTDSLADAGYPGAASLGDAVCGMASARITSKDFLFWFRSHTAKEMKWGGVKHHPDDKDDARRMHPRSSFKAFLEVVKRRSLPWDNVEIDAIHSLQLILRGSFQDIDDSGTKTMVHSRLNDLRLQGIDELSSVASEMVRLIETTTAPILAVDYNGLVNGWNAKVAELTGLPVGEAMGMSLVQDLVFEESVERVEKMLHNALRGEEEKNVEMMLKTFGPQKEKEAVILVVNACSSRDFTDNIVGVCFVGQDVTSQKVVMDKFIRIQGDYRSIVQSPNPLIPPIFASDEYACCSEWNAAMEKVTGWTHDEVIGKMLVGEIFGGCCRLKGQDAVTKFTIVLHSAIDGQEIEKFPFAFFDKQGKYVEALLTANKRTDADGRITGSFCFLQIASSELQQALEVQRQQEKKCFARLKELAYIRQEIKNPLYGMMFTRKLLEETDLSDDQKQFVETSAVCERQMQKVMDDMDLESLEDGYMELDTAEFILGTVIDAVVSQGMIVLREKGLQLIREIPGEVKTMRLYGDQVRLQQILADFLLNVLRFTPSPEGWVAIKVFPTLKQLGGGLHVVHLEFRITHPGPGLPAELVQDLFDRSQWATQEGVGLSMCRKLLKLMNGDVQYIRESGICYFLVNVEFPMAQREDAASIK

SEQ ID NO: 376 - protein, 200 aa, Pinus radiata
MATVGNKNVQAKLVLLGDMGAGKSSLVLRFVKGQFFAYQESTIGAAFFSQTLAVNETSVKLEIWDTAGQERYHSLAPMYYRGAAAAIIVYDITNLDSFVRAKKWVQELQRQGNPNMVIALAGNKSDMIENSKVSPEEAKVYAQENGLFFMETSAKTAQNVNELFYEIARRLPKAEPVQHPAGMVLADRSAERARSNSCCS

SEQ ID NO: 377 - protein, 247 aa, Pinus radiata
MADSSVRSESVYMSKLAEQAERYDEMVEYMGKVVKAADVEELAVEERNLLSVSYKNAIGSRRASWRIVSSIEQKEESRGNEDRLPLIRQYRLKVEAELSGICDSILGLLDGYLIPSASCGEAKVFYLKMKGDYNRYLAEFKTGDERKEAADGTLEAYKNAQGIALVELASTHPIRLGLALNFSVFYYEIMNMPEKACALAKQAFDEAIAELDTLGEESYKDSTLIMQLLRDNLTLWTSDMQEQLDDS

SEQ ID NO: 378 - protein, 475 aa, Pinus radiata
MDNGMMVWIVLAGVVAMAVWYLLVQHQQPKQSHNVPWETLPPGAVGWPFLGEIISFYFRTPDFVKQRRGRYGNLFRTFLIGYPMVISTDPEVNKFILNNDGRLFVPAYPSHWSQIIGECNIFAARGDFHKRMRGAFLHFISISVVKNRLLSEIQNIITFSLAGWEGRNVNVLHEAEEMIFSVMANHMLSLSAGTALESMKRDFLVMMKGLRSLPLRVPGTTFYKSLQKKQVLFNQIKSIIEERKLNMSAYDSYDDLLSSILRSASEKEFTTTQIVDLIVQSVIGSLETTPKIMASVVRHLSENPHIIIYLKEEHETIIQAKENNQSLSWDDYKSMVFTKSVIKETLRFGMQPLNNIMFKKTLQDVKIEGYTIPKGWTCIIYDLVSDMDTKYCKDPLSFNPQRWQSKEMNEVPFLAFGGGPRLCPGYELAMLTMSFFLHHLVTKFRWEYLPSKSELRWFDSPLNSVFDCRIHVENR

SEQ ID NO: 379 - protein, 225 aa, Pinus radiata
MAILYALVGRGTVVLAEFSAVGGNAGTVARRIMEKLPLQDRGEGESRLCYSQDRHIFHILRGSDGLTFLCMANDTFGRQIPFAYLEDIQMRFMKTYGRVAQNALAYAMNDEFSRVLHQQMEYFSSNPNADTLTRVRGEMNEVRTVMVENIEKILERGDRIELLVDKTSTIQDSSFHFKKQSRRLRQALWMKNAKLLASLTCLIVVLLYIIIALCCGGITLPSCRS

SEQ ID NO: 380 - protein, 262 aa, Pinus radiata
MGEFKKWKRCNSLPSPINSLDDGCLMRIFSFLSPLPDRYSAARVCSRWRHLASDPRMWLRVEKSCNALAESGIFSTIEDAVVAARPGDTILIATGVVHMACNIQIVKPICLVGGGSSPDETVLVCPRGFDSALEFLSTGKVANLTIKAELGSCLLHRNGRLTVEGCVLQCEEHPLEHLCCPIVSTADALAPPSTLSSVMKGGSSMSVIHTRIKGGAKAVLTNGSLTLQQVRVIYSPTALFFWFNVSQKSLTDIDLPPFICKA

SEQ ID NO: 381 - protein, 547 aa, Pinus radiata
MGSTNNQSERAFSIKLWPPSESTRLMLVERMTDNLSSVSFFSRKYGLLSKEEAAENAKRIEETAFLAANDHEAKETNSDDSSVVQFYAREASRLMLEALKRGPTSQKQESEKELTAETVEVKETIFDISRGDRGFVDGTLAEELLRPLTEEGNSYTKICFSNRSFGLDAARVAERALMEVQRNLTDVDLSDFIAGRPEVEALEVMTIFASVLQGCELRSLNLSDNALGEKGVRAFGPLLKSQKTLEELYFMNNGISVEAARAICELLPSVERLRVLHFHNNMTGDDGAEPLSELVRNCTALEDFRCSSTRVGAVGGIALVGALGAGNRLKKLDLRDNMFGKKCGVALSRALSPHLGLTEAYLSYLGFQDKGTIALANSLKEGAPSLKVLELAGNEITVKAATALAECLGLKRMLTKLVLSENELKDEGSVLICRALEEGHEHLKELDLSSNSISGVGAKVAAELVVNKPDFDLLNIDGNCISEEGIDAVKDVLRRGDKGVTVLGSLEDNDAEGEGNDYEDGDEDDDENESSDSDGDLVAKVEDLKMQ

SEQ ID NO: 382 - protein, 262 aa, Pinus radiata
MSPAESSREESVYMAKLAEQAERYEEMVEYMEKVAKTVDVEELTVEERNLLSVAYKNVIGARRASWRIISSIEQKEESRGNEEHVTMIREYRGKVESELSNICDGILRLLDTHLIPSSTSGESKVFYLKMKGDYHRYLAEFKTGAERKEAAESTLLAYKAAQDIATAELAPTHPIRLGLALNFSVFYYEILNSPDRACTLAKQAFDEAIAELDTLGEESYKDSTLIMQLLRDNLTLWTSDMQEETGGDEIKEAPKKEEGDGH

SEQ ID NO: 383 - protein, 214 aa, Pinus radiata
MARKVDDEYDFLFKVVLIGDSGVGKSNLLSRFTRNEFCLESKSTIGVEFATRTIQVDGKTIKAQIWDTAGQERYRAITSAYYRGAVGALLVYDITKNATFDNVKRWLRELRDHADSNIVIMLVGNKCDLNHLRAVPIDEAQDFAEKEGLSFMETSALESTNVEKAFQSILAEIYQIVKRKSLAAEEAASSGPSQGTPINVTDAEAVAKKRSCCL

SEQ ID NO: 384 - protein, 377 aa, Pinus radiata
MNAGPLIAALRDCPLLAFPSWTAAGIILAYFCYMALAQFILPGKQIPGVVLADKTRIYYRCNGFITLFLLVTLLGISMAAGILSLAVVADKGGELLSTTLILSALISLFLYVAGHLSQSKMTSLKPHITGNFIHDWWFGIQLNPQFLGIDLKFLLIRSGMIGWAVINLSVAAKAFQLKDSLNLSMILYQIFCLLYVMDYFWYEEYMTSTWDIIAENLGFMLVFGDLVWIPFTFSIQGWWLLTHKPDLTKAAAILDVLIFIIGYDSLRGSNKQKHIFKKDPTACIWGEPPKVIGGKLLASGYWGISRHCNYLGDLLLAFSFSLPCGASSFVPYFYPMYLLFLLLWRERRDEAKCREKYKEDWVTYCKLVPWRIIPYLY

SEQ ID NO: 385 - protein, 612 aa, Pinus radiata
MQRPSKTSVGYAIPDEVLKCVMGYLEEPCDRSAVSLVCKRWNRVDALTRKHVTIAFCYTISPSDLGARFPELESLKLKGKPRASMFNLIPQDWGGYAEPWINEISQTLLCLKALHLRRMIVTDEDLRALARARGHILQVLKLEKCSGFSTLGLLEVARSCRSLRVLFLEESTIEDEGGEWLHELALHNSSLEVLNFYMTGLENVNVNDLEMIATNCRSLTSFKISECDILDLRNVFKKATALEEFGGGSFSSSEEQAVEPNIYEMVKFPTNLMSLSGLNYMSETELPVVFPRASSLKKLDLQYTLLSTENYCQLLQSCINIEILEVTNAIGDRGLEVAAENCKKLRRLRVERGEDEAGLEGQQNFVSHKGLSVIAQGCPNLEYIAVYVSDMTNSALESVGKFCKNLRDFRLVLLDKKEQVTDLPLDNGVMALLLGCQKLKRFGFYLRPGGLTDIGLGYIGKFSSNVRWMLLGYVGETDFGLLEFSKGCPNLEKLELRGCCFSEYALSVAALSLRSLKYIWVQGYNATPSGFDLLAMERPFWNIEFTPASQVTVDGFNLEEEITEKPAQILAYYSLAGRRTDHPDSVIPLSLSSWNRQLQHVYEYSLFHAYEY

SEQ ID NO: 386 - protein, 314 aa, Pinus radiata
MAKLYLFVAALLLLSASSAASQSLNTSSDAIPGKDFSTGKQSVEYLRLFAEDISWSNNLVLGLLVPRSIWSPLPRVLQTWLRNYIAGTVVYFVSGSLWSFYIYYWKRNVYIPADSTPSKEPIFLQIMVTMKAMPLYCALPTLSEYMIENGWTRCYAAINEVGWPSYILLTILYLLLVEFGIYWMHRELHDIKVLYKYLHATHHIYNKQNTLSPFAGLAFNPLDGILQAIPHVIALFIIPTHFLTHELLLFCEGIWTTNIHDCIHGKVWPIMGAGYHTIHHTTYRHNYGHYTIWMDWMFGTLRDPTAEAKSVKNM

SEQ ID NO: 387 - protein, 215 aa, Pinus radiata
MAYKTEEDYDYLFKVVLIGDSGVGKSNLLSRFTRNEFSLESKSTIGVEFAARSVNVDGKSIKAQIWDTAGQERYRAITSAYYRGAVGALLVYDITRHVTFENVERWYKELKDHTDVNIVVMLVGNKSDLLHLRAVSVEEGKSFAERESLYFMETSALDSTNVENSFTQVLTQIYRIVSKRSLDTAEEALSTLPGKGQSISVNGKDEFTTKKAGCC

SEQ ID NO: 388 - protein, 257 aa, Pinus radiata
MPETREDSVYLAKLAEQAERYEEMVENMKRVASSDQELTVEERNLLSVAYKNVIGARRASWRIVSSIEQKEESKGNEAQVSMIKGYREKIESELAKICEDILDVLDKHLIPSAASGESKVFYHKMMGDYHRYLAEFATGDKRKDSADKSLEAYKAASEVAVTELPPTHPIRLGLALNFSVFYYEILNSPDRACHLAKQAFDDAIAELDTLSEESYKDSTLIMQLLRDNLTLWTSDMQDSADKPADSKDEPAETPAED

SEQ ID NO: 389 - protein, 281 aa, Pinus radiata
MANERESKTFLARLCEQAERYDEMVTYMKEVAKIGGELTVDERNLLSVAYKNVVGTRRASWRIISSIEQKEESKGTDKHVGTIRDYRQKIETELEKVCQDVLDVLDESLIPKAETGESKVFYHKMKGDYHRYLAEFASGEKRKNAATAAHEAYKSATDVAQTELTPTHPIRLGLALNFSVFYYEILNSPDRACHLAKQAFDDAIAELDSLSEESYRDSTLIMQLLRDNLTLWTSSDGAEPAETGEAPKTEEAKPAETAEAAPAEPESKPAKEEEPAAPAAA

SEQ ID NO: 390 - protein, 359 aa, Pinus radiata
MDALLKQFERLQRPIDLVQTLHETQVKQVPARYILPSEQRPSRPLQVQQSLPVIDLAGLEDTDQRIKIVSQIAQASQEWGFFQIINHDIPVSLLETVKRVSQEFFDLPLEERRKQCPVRPGVHMLEGYGRFFDISDDTVLDWVDTLVHYISPEWAKAVEHWPKNPSTYRETYEKYGEEVMKVMEKLLGLLSQGLGLDPKYIQTLNKESLLQVRINYYPPCPQPDMVNGFKPHSDVDMLTVLLDDGVDGLQVRKDEDWFTVPSIPGALIINIGDLLQIVSNGKYKSAEHRAVANTKQSRMSMVMFLRPQEDVLIDTAPELIDEAHPSLYKAVKAGEYETEYNSKDFRGKDAVHTLRIEQA

SEQ ID NO: 391 - protein, 296 aa, Pinus radiata
MMESLRKLVYYACVSRGPVIVAEYNDLGDAEQLAIAVECLGRAPPFHSRFTHTIKNRRYSFLMDSEFVYYAIVDEALPKVKVFSFLEQVRDEFKRLLRAKGLSNSKDEILQGCGLGDDFASTFRRLVAPLVGIPQTEKRRMEEEEASARRQEDETETEVCSPTASAPLYGKPQPDSKPKKDKKSLCSIPPLILKTNKHEKKKVRDQVTQVREIIMESSGKALDNGQKLEVTVDGNTGGAAALSLQRTASMRTKGQQIAQRMWWRNVRVVLLLDFVVCTILFVVWLCICRGFKCVSD

SEQ ID NO: 392 - protein, 262 aa, Pinus radiata; identical to SEQ ID NO: 199

SEQ ID NO: 393 - protein, 213 aa, Pinus radiata
MTEGSNYDFLFKVVLIGDSGVGKSNLLSRFTRNEFNLDSKSTIGVEFATRSVQVDSKTVKAQIWDTAGQERYRAITSAYYRGAVGALLVYDIAKHPTYQNVHRWLKELRDHADSNIVIMLVGNKSDLKHLRAVPTDEAKAFATENNLSFIETSALDASNVEAAFQNILSDIYHIVAKKNLENSSDVIQPLEGRGIDIAKSEDDGGAKQGGKCC

SEQ ID NO: 394 - protein, 612 aa, Pinus radiata; identical to SEQ ID NO: 385

SEQ ID NO: 395 - DNA, 60 bp, Artificial Sequence
  Description of Artificial Sequence: Synthetic probe
atggtcttatgcgatggtgcagttagtagactgttggtctgtatttacttatttaacaga

SEQ ID NO: 396 - DNA, 60 bp, Artificial Sequence
  Description of Artificial Sequence: Synthetic probe
tttaccttaagatgaaaggtgattaccacaggtatctggcagagtttaagactgcgactg

SEQ ID NO: 397 - DNA, 60 bp, Artificial Sequence
  Description of Artificial Sequence: Synthetic probe
aataattctatagactcacactaccaatggttcacaaagtgattgtggtagacatatgtc

SEQ ID NO: 398 - DNA, 60 bp, Artificial Sequence
  Description of Artificial Sequence: Synthetic probe
attaattatgcagcttctaagggacaatctgacattatggacttctgacatccctgagga

SEQ ID NO: 399 - DNA, 60 bp, Artificial Sequence
  Description of Artificial Sequence: Synthetic probe
tcttagtgggcgctggattgcatcatcagacgggtcaaataatatataattagaagtgta

SEQ ID NO: 400 - DNA, 60 bp, Artificial Sequence
  Description of Artificial Sequence: Synthetic probe
ataatgtgtaattccaaattatgaggtatatttgcaataaacaaaatgcaggtcattttg

SEQ ID NO: 401 - DNA, 60 bp, Artificial Sequence
  Description of Artificial Sequence: Synthetic probe
gaacatagacgaactagctgctctggacactatagatgccgggaagctatttagtgtcgg

SEQ ID NO: 402 - DNA, 60 bp, Artificial Sequence
  Description of Artificial Sequence: Synthetic probe
ggtcgggaagacgtctctcatgaaccagtacgtcaaccgcaagttcagtaaccagtacaa

SEQ ID NO: 403 - DNA, 60 bp, Artificial Sequence
  Description of Artificial Sequence: Synthetic probe
aattggaaaacgctcttgggtttgtgaacgtgcttctcactgctttagtgttggttttca

SEQ ID NO: 404 - DNA, 60 bp, Artificial Sequence
  Description of Artificial Sequence: Synthetic probe
aattctgcattgagtgtagcagatcccttctattagattattcatatgactatgtgactg

SEQ ID NO: 405 - DNA, 60 bp, Artificial Sequence
  Description of Artificial Sequence: Synthetic probe
ttcaatatctcaattgaacacgataaaaggcctccatgtctatgcagattgttgcctact

SEQ ID NO: 406 - DNA, 60 bp, Artificial Sequence
  Description of Artificial Sequence: Synthetic probe
gtggtctgctaccaatctttctatgataatggtaccgtttctattatattagagtatatg

SEQ ID NO: 407 - DNA, 60 bp, Artificial Sequence
  Description of Artificial Sequence: Synthetic probe
ttgcactgtcttattttatcaatttgtatcctaatacgtggccaatgaactttacggttt

SEQ ID NO: 408 - DNA, 60 bp, Artificial Sequence
  Description of Artificial Sequence: Synthetic probe
aagaaatatataacaatgtgagcaggaaggttctaaattcagatgcttataaagcagagc

SEQ ID NO: 409 - DNA, 60 bp, Artificial Sequence
  Description of Artificial Sequence: Synthetic probe
ttcagttgcacagtaaacatgtctgtatcctgtgcagtaggactcttgtaactagtctgt

SEQ ID NO: 410 - DNA, 60 bp, Artificial Sequence
  Description of Artificial Sequence: Synthetic probe
ttttgaaggttaataaaagtattacgctagaacaattacagaggctgcttgtccgtgctc

SEQ ID NO: 411 - DNA, 60 bp, Artificial Sequence
  Description of Artificial Sequence: Synthetic probe
ctcaagaactgtagcatatgttatgaccattgcaaaggttttaactgctgcggtatcatg

SEQ ID NO: 412 - DNA, 60 bp, Artificial Sequence
  Description of Artificial Sequence: Synthetic probe
aaatcgtgcgttgtgaaattggttgtgtataatctctagaatccaaaggcttacgggtca

SEQ ID NO: 413 - DNA, 60 bp, Artificial Sequence
  Description of Artificial Sequence: Synthetic probe
gaactgtcttcgggcgagtttaatcatgtatctgatttacgatcggtgttgtgaacgtcg

SEQ ID NO: 414 - DNA, 60 bp, Artificial Sequence
  Description of Artificial Sequence: Synthetic probe
tcccaaccgttgggggattttttgacgagtcagtaccaaatttatagttgcctactgacc

SEQ ID NO: 415 - DNA, 60 bp, Artificial Sequence
  Description of Artificial Sequence: Synthetic probe
tatatttttctcttacacaaaatgtcgtcagatataaattggtctgggaattgtcgatgc

SEQ ID NO: 416 - DNA, 60 bp, Artificial Sequence
  Description of Artificial Sequence: Synthetic probe
tgcattggattctaccaatgtcgagagtgcattcttgactgtcttgaccgagatattcaa

SEQ ID NO: 417 - DNA, 60 bp, Artificial Sequence
  Description of Artificial Sequence: Synthetic probe
tgtatcagattctacgtggactgaagtatatccactctgcgaatgttattcatagagact

SEQ ID NO: 418 - DNA, 60 bp, Artificial Sequence
  Description of Artificial Sequence: Synthetic probe
tccatgtactaggtttcctatctaacctgtaaatagccttattgctatgagacttcaggc

SEQ ID NO: 419 - DNA, 60 bp, Artificial Sequence
  Description of Artificial Sequence: Synthetic probe
ttgaatcttagttatgctcctgggatccctggaagtgagctaactaagttaatccgtcat

SEQ ID NO: 420 - DNA, 60 bp, Artificial Sequence
  Description of Artificial Sequence: Synthetic probe
tatgtagatctttgtggctgtaacatgtacttcttgcttacctgttcgatgctatataat

SEQ ID NO: 421 - DNA, 60 bp, Artificial Sequence
  Description of Artificial Sequence: Synthetic probe
gagtgccacaggattaccctgtcaggactatatggtcttgtcgttggttgtggggataaa

SEQ ID NO: 422 - DNA, 60 bp, Artificial Sequence
  Description of Artificial Sequence: Synthetic probe
caacttgtcgaatcacttcgcaaccggattcaaaatgaggctactgttgcatactacttg

SEQ ID NO: 423 - DNA, 60 bp, Artificial Sequence
  Description of Artificial Sequence: Synthetic probe
tgtttttaggacacaatgtattaggtgcttgatgctagcgcggacacattgtattatttt

SEQ ID NO: 424 - DNA, 60 bp, Artificial Sequence
  Description of Artificial Sequence: Synthetic probe
catcagacggtgaatccaaagtattttactataagatgaagggagactactaccgttatc

SEQ ID NO: 425 - DNA, 60 bp, Artificial Sequence
  Description of Artificial Sequence: Synthetic probe
aaagataactgatttacccctggacaatggtgtcagggctattttaaggggatgtgaaaa

SEQ ID NO: 426 - DNA, 60 bp, Artificial Sequence
  Description of Artificial Sequence: Synthetic probe
agattctaacatagttattatgatggctgggaacaagtctgatttgaaccacctaagagc

SEQ ID NO: 427 - DNA, 60 bp, Artificial Sequence
  Description of Artificial Sequence: Synthetic probe
tatttgaactctgtcccaatatgtactttgatttatggattgtaacgatgtactcaattg

SEQ ID NO: 428 - DNA, 60 bp, Artificial Sequence
  Description of Artificial Sequence: Synthetic probe
gtcattgtgactcatgttagtatttgacatgattcgtgttaaattatttatgaaatattg

SEQ ID NO: 429 - DNA, 60 bp, Artificial Sequence
  Description of Artificial Sequence: Synthetic probe
agaattggtccgtgatagtgccaccggaggttgagatctatgagcttaaaactaatgctt

SEQ ID NO: 430 - DNA, 60 bp, Artificial Sequence
  Description of Artificial Sequence: Synthetic probe
ggagtcttcaacggcggtgatgtaaaatatctatcccaatgtatacctcctgtcctggaa

SEQ ID NO: 431 - DNA, 60 bp, Artificial Sequence
  Description of Artificial Sequence: Synthetic probe
atgagggagttaatttatagggaagcgcttgcatttaatcccgagtatctacagtaatgg

SEQ ID NO: 432 - DNA, 60 bp, Artificial Sequence
  Description of Artificial Sequence: Synthetic probe
tttttaagaagtgataatgcacgaagatatgtaagacagcttccacagtacccaagacag

SEQ ID NO: 433 - DNA, 60 bp, Artificial Sequence
  Description of Artificial Sequence: Synthetic probe
tgcaagggtatcgacagtctgcatgtcgtgaaggtccccgagtgttcgaatttaggtctt

SEQ ID NO: 434 - DNA, 60 bp, Artificial Sequence
  Description of Artificial Sequence: Synthetic probe
gccagatgtctaatgcggccttacttaccatagctcggaaccgtcctaacatgactcgat

SEQ ID NO: 435 - DNA, 60 bp, Artificial Sequence
  Description of Artificial Sequence: Synthetic probe
atgatagtaactggccagaacctgaccgtgtgggacggcaagaacttgagattgtaatgg

SEQ ID NO: 436 - DNA, 60 bp, Artificial Sequence
  Description of Artificial Sequence: Synthetic probe
tttccagactattctctcagagatatacaggataattagtaagaagcctctgtcctcaga

SEQ ID NO: 437 - DNA, 60 bp, Artificial Sequence
  Description of Artificial Sequence: Synthetic probe
aatccgggagggtgtaccaggactattgtgaggccatgagcagactgtctctaggaataa

SEQ ID NO: 438 - DNA, 60 bp, Artificial Sequence
  Description of Artificial Sequence: Synthetic probe
cccttgggatgcgtatacgatgcggctcaaggtgtatcaattcgtgttacagataccatt

SEQ ID NO: 439 - DNA, 60 bp, Artificial Sequence
  Description of Artificial Sequence: Synthetic probe
tttgtaatccccctgaataatggagttactattgatcagtggatattgcttactatgttg

SEQ ID NO: 440 - DNA, 60 bp, Artificial Sequence
  Description of Artificial Sequence: Synthetic probe
gatttttaaccccacggttgtttatgatcacttgggcgaaatatactccgcactcattgt

SEQ ID NO: 441 - DNA, 60 bp, Artificial Sequence
  Description of Artificial Sequence: Synthetic probe
gacaagttaagactattctagaaccatatttagcagtggtctgtaagcaggtcttacaag

SEQ ID NO: 442 - DNA, 60 bp, Artificial Sequence
  Description of Artificial Sequence: Synthetic probe
cagcgtcggccactctcgataaaactctggccgcctagtcaaagtactaggattatgctt

SEQ ID NO: 443 - DNA, 60 bp, Artificial Sequence
  Description of Artificial Sequence: Synthetic probe
tcattccttatgcagttgtggcaatagatttgccatgttaagtagtgaatagagaaccct

SEQ ID NO: 444 - DNA, 60 bp, Artificial Sequence
  Description of Artificial Sequence: Synthetic probe
tgatcctggcgatgcgttcttggtgccaaccccttactatgcaggatttgatcgagattt

SEQ ID NO: 445 - DNA, 60 bp, Artificial Sequence
  Description of Artificial Sequence: Synthetic probe
ttcttgttggttcctgcattgagagagacctaattgcttgatgtcctgtaatttgtaaaa

SEQ ID NO: 446 - DNA, 60 bp, Artificial Sequence
  Description of Artificial Sequence: Synthetic probe
ctttacatggtccttcattatactatagcctatagaagaaatacatttgcatgtatagtt

SEQ ID NO: 447 - DNA, 60 bp, Artificial Sequence
  Description of Artificial Sequence: Synthetic probe
tctctagatccttagattaaggtttgatctgtgtatatgctgtgtcgttgcctgagaatg

SEQ ID NO: 448 - DNA, 60 bp, Artificial Sequence
  Description of Artificial Sequence: Synthetic probe
ggatgacgatttgtttcaagatcgttttagcattgcatacaaccttgaccgagagtttgg

SEQ ID NO: 449 - DNA, 60 bp, Artificial Sequence
  Description of Artificial Sequence: Synthetic probe
cttgactcgatatctttgtgctgttgtctgtagtatatatcagtaccagttagttttact

SEQ ID NO: 450 - DNA, 60 bp, Artificial Sequence
  Description of Artificial Sequence: Synthetic probe
ttggatttgctaggatctaactgcctcacgttggagagactggcgttttgcggtagcgat

SEQ ID NO: 451 - DNA, 60 bp, Artificial Sequence
  Description of Artificial Sequence: Synthetic probe
caaagcagatacagctgttgccaaaagtctgaataaggagttcgggccaattatgaagga

SEQ ID NO: 452 - DNA, 60 bp, Artificial Sequence
  Description of Artificial Sequence: Synthetic probe
cgactctaacattgttataatgcttgtggggaataaggctgatttgcgacatttacgtgc

SEQ ID NO: 453 - DNA, 60 bp, Artificial Sequence
  Description of Artificial Sequence: Synthetic probe
ctgccttagcattaacgggaaccacatgggtgtccatgtgtggattatgaaagagtatgg

SEQ ID NO: 454 - DNA, 60 bp, Artificial Sequence
  Description of Artificial Sequence: Synthetic probe
ttcttttgaattcgctatccagtgttggtcaaattttagccaataatttaagttgtttct

SEQ ID NO: 455 - DNA, 60 bp, Artificial Sequence
  Description of Artificial Sequence: Synthetic probe
atggagctagtcgtttgactagtacctgtatgtagatctaatggaagctacagagttctg

SEQ ID NO: 456 - DNA, 60 bp, Artificial Sequence
  Description of Artificial Sequence: Synthetic probe
ttcgatgcgaagtctaatgactatcgtgttgtcaggattatccgatacctaggtattcgc

SEQ ID NO: 457 - DNA, 60 bp, Artificial Sequence
  Description of Artificial Sequence: Synthetic probe
aagaatcttgaagtaggtgaagagtaggatatgttctttctagtttaaggtaatttgaat

SEQ ID NO: 458 - DNA, 60 bp, Artificial Sequence
  Description of Artificial Sequence: Synthetic probe
gatgcttcgggcagtgaaattgctgttcgagaactaatgaaggaaccttcttgactagtt

SEQ ID NO: 459 - DNA, 60 bp, Artificial Sequence
  Description of Artificial Sequence: Synthetic probe
gttcacttcattacgttttatgcgccactctggggagcaatcctttataacggtttttca

SEQ ID NO: 460 - DNA, 60 bp, Artificial Sequence
  Description of Artificial Sequence: Synthetic probe
gttttgctcctgtaccgtgagactctcgtttggtacgatttagataccggtgacgttgag

SEQ ID NO: 461 - DNA, 60 bp, Artificial Sequence
  Description of Artificial Sequence: Synthetic probe
aaaggcgactcgtgttcatagaaacatctgctaagactgccactaatgttagcaaactgt

SEQ ID NO: 462 - DNA, 60 bp, Artificial Sequence
  Description of Artificial Sequence: Synthetic probe
ggtcttgtggttatatatgccagttgtctcttttacagtgagttttgtgtaactcctaaa

SEQ ID NO: 463 - DNA, 60 bp, Artificial Sequence
  Description of Artificial Sequence: Synthetic probe
gacagagatcgctaaaaccatagaatccgagctacagaagtttgaaaacggaagtgggat

SEQ ID NO: 464 - DNA, 60 bp, Artificial Sequence
  Description of Artificial Sequence: Synthetic probe
gaatctcattctgaccctggctcgtgaatactttcatatgtacacagtatttcaccggac

SEQ ID NO: 465 - DNA, 60 bp, Artificial Sequence
  Description of Artificial Sequence: Synthetic probe
ggagttgtgtagtgttactctcccgaatcagacattaaacacttacttctacatgaggcc

SEQ ID NO: 466 - DNA, 60 bp, Artificial Sequence
  Description of Artificial Sequence: Synthetic probe
tgttactaagaatagggtcttgtttcatggtctactaatgtaatgaatctcgctctttat

SEQ ID NO: 467 - DNA, 60 bp, Artificial Sequence
  Description of Artificial Sequence: Synthetic probe
actttcagtacaaataactcactcgttcaataatttccgtgggctgtgttaattttaaag

SEQ ID NO: 468 - DNA, 60 bp, Artificial Sequence
  Description of Artificial Sequence: Synthetic probe
agagcagtgatggtcaggcatataaagtttatgtttaccgcactgttgctggaccaagga

SEQ ID NO: 469 - DNA, 60 bp, Artificial Sequence
  Description of Artificial Sequence: Synthetic probe
gattaattaaatcggattccccgaaatgggatgacgtgctataaggacgtagccactgcc

SEQ ID NO: 470 - DNA, 60 bp, Artificial Sequence
  Description of Artificial Sequence: Synthetic probe
gaacaatccgcccatgtacagggagacctctttcacagagtattttgggtattacctctc

SEQ ID NO: 471 - DNA, 60 bp, Artificial Sequence
  Description of Artificial Sequence: Synthetic probe
tctctgctcattaccgtttcagtggctgataatggattcccacgatgcaattgcgatgac

SEQ ID NO: 472 - DNA, 60 bp, Artificial Sequence
  Description of Artificial Sequence: Synthetic probe
tagaaaatgcctttgcagaagtgctaacgcagatctaccgtaccactagtaagaagacag

SEQ ID NO: 473 - DNA, 60 bp, Artificial Sequence
  Description of Artificial Sequence: Synthetic probe
gttttgtactattggcgtttggcagaagttatttggccagtacgtagctggctaaacaag

SEQ ID NO: 474 - DNA, 60 bp, Artificial Sequence
  Description of Artificial Sequence: Synthetic probe
tttcacggggcatctctacactgatgtaaataatgtacttatttatagctgacagtcgag

SEQ ID NO: 475 - DNA, 60 bp, Artificial Sequence
  Description of Artificial Sequence: Synthetic probe
aattattaaagtggacatcgtttgttttatgtgacacacctgacactaatattcgtaatt

SEQ ID NO: 476 - DNA, 60 bp, Artificial Sequence
  Description of Artificial Sequence: Synthetic probe
tctcctagtgttggtgtactgttgtaatcaatggaaaggtatgttaggcgacgatattat

SEQ ID NO: 477 - DNA, 60 bp, Artificial Sequence
  Description of Artificial Sequence: Synthetic probe
cttggaaatgcttacttgcgagtatccttacattgaatgcaccaatccggctcaaattta

SEQ ID NO: 478 - DNA, 60 bp, Artificial Sequence
  Description of Artificial Sequence: Synthetic probe
ttcctctggtgcttctacatttattacctcaagcgcaatgtttacgtcccgaaggatgag

SEQ ID NO: 479 - DNA, 60 bp, Artificial Sequence
  Description of Artificial Sequence: Synthetic probe
tggtagcatcggtagactacatctatgctgtaaactattcctatcctataatagttgcat

SEQ ID NO: 480 - DNA, 60 bp, Artificial Sequence
  Description of Artificial Sequence: Synthetic probe
ccaatccaatgttatttcttattagcgctaagaccttacctctggatcccttcgttgaaa

SEQ ID NO: 481 - DNA, 60 bp, Artificial Sequence
  Description of Artificial Sequence: Synthetic probe
tagattgatcgatttgaaggctatctactttcaaaaggatacatgttgtgcttatgatta

SEQ ID NO: 482 - DNA, 60 bp, Artificial Sequence
  Description of Artificial Sequence: Synthetic probe
aatcaaatgcattcttgagtgatgtcctacttaatttgtctttcatgacgcggcttttct

SEQ ID NO: 483 - DNA, 60 bp, Artificial Sequence
  Description of Artificial Sequence: Synthetic probe
gatgtcgtttggtatgatttacatgctaggtacatcaatagggtagatataaggggcatg

SEQ ID NO: 484 - DNA, 60 bp, Artificial Sequence
  Description of Artificial Sequence: Synthetic probe
agtttattaatgtaggatttcccttttatagttaaaagagtgattaggtggggttagacc

SEQ ID NO: 485 - DNA, 60 bp, Artificial Sequence
  Description of Artificial Sequence: Synthetic probe
atatcacagagcgtccatggtctgccactatctctatttgacaatttgtaatatgtaatt

SEQ ID NO: 486 - DNA, 60 bp, Artificial Sequence
  Description of Artificial Sequence: Synthetic probe
atatacgtttacacgagagaaataaattacaatctgcgattatatcccgatccactagct

SEQ ID NO: 487 - DNA, 60 bp, Artificial Sequence
  Description of Artificial Sequence: Synthetic probe
ggtccttcaaagtacgtgggctcaaataaagcgttaatatgtatggtaactggtacttca

SEQ ID NO: 488 - DNA, 60 bp, Artificial Sequence
  Description of Artificial Sequence: Synthetic probe
ggggtgttaatcaaacgtttacttgtgtaaccagtgtagagatagaattgtactctagta

SEQ ID NO: 489 - DNA, 60 bp, Artificial Sequence
  Description of Artificial Sequence: Synthetic probe
gaagggctgacagatacaggtcttggttatattggcgagtacagcactaatgtaaggtgg

SEQ ID NO: 490 - DNA, 60 bp, Artificial Sequence
  Description of Artificial Sequence: Synthetic probe
gaaataccaagggcactagagttcaagtagacgtttataatttaaccggccattcaacat

SEQ ID NO: 491 - DNA, 60 bp, Artificial Sequence
  Description of Artificial Sequence: Synthetic probe
ttcagtggggcagagactctgattgcgtacagcaactttagtgtattatatcaaggtcat

SEQ ID NO: 492 - DNA, 60 bp, Artificial Sequence
  Description of Artificial Sequence: Synthetic probe
agaacgagtttatgcatgagaagctatgatcccatggttattagggtgtaggtcattatt

SEQ ID NO: 493 - DNA, 60 bp, Artificial Sequence
  Description of Artificial Sequence: Synthetic probe
tgaatattgtacctgagagcattcattgacttgtaatgaatgtacactctcttggtctct

SEQ ID NO: 494 - DNA, 60 bp, Artificial Sequence
  Description of Artificial Sequence: Synthetic probe
ttgtactagactatactatgggacgcctaacctgtcatttaaaaatgtgagactgttcgt

SEQ ID NO: 495 - DNA, 60 bp, Artificial Sequence
  Description of Artificial Sequence: Synthetic probe
attgtgtattcctaatctgagccaactattggcctctactttattatcattggacattaa

SEQ ID NO: 496 - DNA, 60 bp, Artificial Sequence
  Description of Artificial Sequence: Synthetic probe
tcaatactttccaaggggttcgcaaggtcttttgcaatgtctagccagattattccatgt

SEQ ID NO: 497 - DNA, 60 bp, Artificial Sequence
  Description of Artificial Sequence: Synthetic probe
agaagcccttccgtgtcttcgatatacgtgcccgatcttgtagacaatctttagtatatg

SEQ ID NO: 498 - DNA, 60 bp, Artificial Sequence
  Description of Artificial Sequence: Synthetic probe
tcttttggcatagtgtttcctgatgcacggtgcagatatatgacttggcatctagatcag

SEQ ID NO: 499 - DNA, 60 bp, Artificial Sequence
  Description of Artificial Sequence: Synthetic probe
ggaaaaactttgaccgatttctggaatcacttatagttgaattcgagcaggttctcattt

SEQ ID NO: 500 - DNA, 60 bp, Artificial Sequence
  Description of Artificial Sequence: Synthetic probe
acaaaagaccagtaggacattatggggtcttaacttggtgtgtataccatggctattaaa

SEQ ID NO: 501 - DNA, 60 bp, Artificial Sequence
  Description of Artificial Sequence: Synthetic probe
ttggcgaatctactgttttctactataaaatgaaaggagactactaccgttatctggctg

SEQ ID NO: 502 - DNA, 60 bp, Artificial Sequence
  Description of Artificial Sequence: Synthetic probe
gtgaaatgtgataatcttatagtgtattaggattaggattagattaccaggctttcctgc

SEQ ID NO: 503 - DNA, 60 bp, Artificial Sequence
  Description of Artificial Sequence: Synthetic probe
atggtagtttaccagattatatggttactatcaactgttcgattgttctagtgtgcagta

SEQ ID NO: 504 - DNA, 60 bp, Artificial Sequence
  Description of Artificial Sequence: Synthetic probe
tcagacgttagaactctggttagctgtgcatcctatagtaacgtctctgtaatacggtgt

SEQ ID NO: 505 - DNA, 60 bp, Artificial Sequence
  Description of Artificial Sequence: Synthetic probe
aatttggaactcaattatcatggccatatcaaatgcgaaatgaagggtgtcattgtttct

SEQ ID NO: 506 - DNA, 60 bp, Artificial Sequence
  Description of Artificial Sequence: Synthetic probe
tttgtgcaccctgttacaactcgccagtataggtctaaatctgcatttacacaacccact

SEQ ID NO: 507 - DNA, 60 bp, Artificial Sequence
  Description of Artificial Sequence: Synthetic probe
agattggagttgtgtattctaaatcgaggccagctattgggccttatgcgattattatta

SEQ ID NO: 508 - DNA, 60 bp, Artificial Sequence
  Description of Artificial Sequence: Synthetic probe
ggttctggttataaacttatgttcaataaagaattagaattagattaatctatataggaa

SEQ ID NO: 509 - DNA, 60 bp, Artificial Sequence
  Description of Artificial Sequence: Synthetic probe
ttcagtcatcctaaactgcaggtctacttccgagagttgttgaaacccgtttagattcta

SEQ ID NO: 510 - DNA, 60 bp, Artificial Sequence
  Description of Artificial Sequence: Synthetic probe
attcgaacctcgactattcagtttccgatgcggtcagagacaagctgcggcttatgagag

SEQ ID NO: 511 - DNA, 60 bp, Artificial Sequence
  Description of Artificial Sequence: Synthetic probe
ggtttaagttaggttggaactttgaagtacattagtgttctgcactttatatcctaagtt

SEQ ID NO: 512 - DNA, 60 bp, Artificial Sequence
  Description of Artificial Sequence: Synthetic probe
ttattacattacctgggtaagaagtggagtttagctgctcagaggcagatagtaacaagc

SEQ ID NO: 513 - DNA, 60 bp, Artificial Sequence
  Description of Artificial Sequence: Synthetic probe
agctattatttgtttgaggagcaatggacatgacacctacatatttatttaaggtaggga

SEQ ID NO: 514 - DNA, 60 bp, Artificial Sequence
  Description of Artificial Sequence: Synthetic probe
gaatttccgtggttatggctctgctacatatgggcaacctgttagggctatcctactaaa

SEQ ID NO: 515 - DNA, 60 bp, Artificial Sequence
  Description of Artificial Sequence: Synthetic probe
aataaggtggattattaaatcgcgtatttttaacttatctaatatctatttactgactcg

SEQ ID NO: 516 - DNA, 60 bp, Artificial Sequence
  Description of Artificial Sequence: Synthetic probe
gacatctccgctctttagttaatgggtctctcatttcctgaacgtctaggcaggcctatc

SEQ ID NO: 517 - DNA, 60 bp, Artificial Sequence
  Description of Artificial Sequence: Synthetic probe
gcctttctaatcgagcagatattgatggactgaacacgatgtgtatatggagcgtgcttt

SEQ ID NO: 518 - DNA, 60 bp, Artificial Sequence
  Description of Artificial Sequence: Synthetic probe
ttaaagggctgaagagaagtcgatcggtgtacgttgttgtcgtcaggttgcaggttcgaa

SEQ ID NO: 519 - DNA, 60 bp, Artificial Sequence
  Description of Artificial Sequence: Synthetic probe
taattgccccgctgtggacatataaatatcatgtccgttggtgtgagtagatatcatgtc

SEQ ID NO: 520 - DNA, 60 bp, Artificial Sequence
  Description of Artificial Sequence: Synthetic probe
tttcgataattcaatttccgacgcggtcagaaccaagctgaggcaaatgcgagatgtcat

SEQ ID NO: 521 - DNA, 60 bp, Artificial Sequence
  Description of Artificial Sequence: Synthetic probe
actgttggtggaaatatgtgatgccaaatgctaggaaaaattatttagatattattgcat

SEQ ID NO: 522 - DNA, 60 bp, Artificial Sequence
  Description of Artificial Sequence: Synthetic probe
attttacggagagcataagctataaaagcaaatcggtctgcagtgtattatcgacatccc

SEQ ID NO: 523 - DNA, 60 bp, Artificial Sequence
  Description of Artificial Sequence: Synthetic probe
cttcttactgcttcagctctacaaattagtgtggggggcgagcagtcgagcctataagtt

SEQ ID NO: 524 - DNA, 60 bp, Artificial Sequence
  Description of Artificial Sequence: Synthetic probe
cacttggcaccctgcggacacaagtcctaggtttaatcgcatatgttggcgtgactagat

SEQ ID NO: 525 - DNA, 60 bp, Artificial Sequence
  Description of Artificial Sequence: Synthetic probe
tgactgatttgcttggcactccgtcaacagaaacactttctaggatccgcaatgagaagg

SEQ ID NO: 526 - DNA, 60 bp, Artificial Sequence
  Description of Artificial Sequence: Synthetic probe
gcatgtcagttttaagagacaagcaccctgctattgctctgtatgatttattagtgaacc

SEQ ID NO: 527 - DNA, 60 bp, Artificial Sequence
  Description of Artificial Sequence: Synthetic probe
agcttgcaccaacgtaggtcaccagttaatatgcattcttctttcagaaattcaaggaag

SEQ ID NO: 528 - DNA, 60 bp, Artificial Sequence
  Description of Artificial Sequence: Synthetic probe
ataagtttgtagctatcaacatgactaagctttagtgaagggctatacaatgcatcttta

SEQ ID NO: 529 - DNA, 60 bp, Artificial Sequence
  Description of Artificial Sequence: Synthetic probe
ggaggctattggttaatacatataaagggtggtaaagcgctgttcatatttttcctagaa

SEQ ID NO: 530 - DNA, 60 bp, Artificial Sequence
  Description of Artificial Sequence: Synthetic probe
ggaagaactttgcgtttccctgcatttctacttgtacccttattcattcattcaagaaaa

SEQ ID NO: 531 - DNA, 60 bp, Artificial Sequence
  Description of Artificial Sequence: Synthetic probe
atcttgattacttggcagtcctttctagatacaatcctttcgaggcatttatattcattt

SEQ ID NO: 532 - DNA, 60 bp, Artificial Sequence
  Description of Artificial Sequence: Synthetic probe
gtgctgtagatatgttcaagagacaatttgctcatctagaggaacactatagtaaaggtg

SEQ ID NO: 533 - DNA, 60 bp, Artificial Sequence
  Description of Artificial Sequence: Synthetic probe
ccagaacctactaaactggatgctaaatgagccagacgttccaaataatagacagttaac

SEQ ID NO: 534 - DNA, 60 bp, Artificial Sequence
  Description of Artificial Sequence: Synthetic probe
agacctcttaatccatggtgagagcatgaggtctaataagttcggaaccgtgtattcatc

SEQ ID NO: 535 - DNA, 60 bp, Artificial Sequence
  Description of Artificial Sequence: Synthetic probe
aagtaacattttgtgcagacagtggttacaactttgaaaattggaagctgggctattttc

SEQ ID NO: 536 - DNA, 60 bp, Artificial Sequence
  Description of Artificial Sequence: Synthetic probe
ttttcgaaagctcatcgagcagctatagaaacattaatgcatgaaagagatctaaatatt

SEQ ID NO: 537 - DNA, 60 bp, Artificial Sequence
  Description of Artificial Sequence: Synthetic probe
tgcaaattagtaccattcgacagctgccacctgcccattgtttgattccacgtggcacag

SEQ ID NO: 538 - DNA, 60 bp, Artificial Sequence
  Description of Artificial Sequence: Synthetic probe
tttgaagtgagtaacacctagacatgacattgtacaacttaaagaacaatagaaatttgc

SEQ ID NO: 539 - DNA, 60 bp, Artificial Sequence
  Description of Artificial Sequence: Synthetic probe
tttacagttgtagttgtttgcacgaattgttgagtaacttctttactcatttgagggttt

SEQ ID NO: 540 - DNA, 60 bp, Artificial Sequence
  Description of Artificial Sequence: Synthetic probe
ttgatcttatggatctgacaaacaatgcactgatttattcgtatgagaccaaaaaatctc

SEQ ID NO: 541 - DNA, 60 bp, Artificial Sequence
  Description of Artificial Sequence: Synthetic probe
gatgatccaaggtatctcgtcatgtccttaagagcttggtttctctttctatcccagttt

SEQ ID NO: 542 - DNA, 60 bp, Artificial Sequence
  Description of Artificial Sequence: Synthetic probe
gcaaatgaacagcctggcagattcctagtctggaattaggcagtaaatagttatttaatt

SEQ ID NO: 543 - DNA, 60 bp, Artificial Sequence
  Description of Artificial Sequence: Synthetic probe
acatctaagtggttttatgtacatataagaaactggcatgtttatgagtggaacaacttt

SEQ ID NO: 544 - DNA, 60 bp, Artificial Sequence
  Description of Artificial Sequence: Synthetic probe
ctgtaaaacttatctttgtatataacaagattgagcatgcctagaatagaaagaacaatt

SEQ ID NO: 545 - DNA, 60 bp, Artificial Sequence
  Description of Artificial Sequence: Synthetic probe
ttaatcaaatctgcagtgttaaccacctgttatctacatgggattcttacaagctattct

SEQ ID NO: 546 - DNA, 60 bp, Artificial Sequence
  Description of Artificial Sequence: Synthetic probe
aagtggttatgattatccaaagttcgtatccgcagattacatgacagtgtatgctgcgca

SEQ ID NO: 547 - DNA, 60 bp, Artificial Sequence
  Description of Artificial Sequence: Synthetic probe
aagatgagatgtagagatggataaagtttgaatatatctcaaagcacggccttgagtttt

SEQ ID NO: 548 - DNA, 60 bp, Artificial Sequence
  Description of Artificial Sequence: Synthetic probe
aattaataccggttgagtttgttcggttacacaatatatgacttcatgattagccattta

SEQ ID NO: 549 - DNA, 60 bp, Artificial Sequence
  Description of Artificial Sequence: Synthetic probe
aaatgtcgggtcgcagaaatccgctgttgaatatcccaattcctgctcggcaacagactc

SEQ ID NO: 550 - DNA, 60 bp, Artificial Sequence
  Description of Artificial Sequence: Synthetic probe
agagcgagtcttttataacaggttattttattgtaagaaagcacacttgtttatgtgtaa

SEQ ID NO: 551 - DNA, 60 bp, Artificial Sequence
  Description of Artificial Sequence: Synthetic probe
tccacatgcacggtccagtcctcagtgttcacccataaggacaccccatgtttgttaatg

SEQ ID NO: 552 - DNA, 60 bp, Artificial Sequence
  Description of Artificial Sequence: Synthetic probe
aatgctcggacacagtaaattaaattcactcgagaataagttcctcgccattcacaataa

SEQ ID NO: 553 - DNA, 60 bp, Artificial Sequence
  Description of Artificial Sequence: Synthetic probe
cttaggcttgagccctagatgctgtacacagagcagaataatagtgatgtattaagtaat

SEQ ID NO: 554 - DNA, 60 bp, Artificial Sequence
  Description of Artificial Sequence: Synthetic probe
ggatatctgaggtattgatgttgtacgatcctcagatctacctttgatgcgttatgctga

SEQ ID NO: 555 - DNA, 60 bp, Artificial Sequence
  Description of Artificial Sequence: Synthetic probe
gaactatgctttaacctctttcaaatgtgtttgtcaaatgctttcatagctttatatatt

SEQ ID NO: 556 - DNA, 60 bp, Artificial Sequence
  Description of Artificial Sequence: Synthetic probe
atcataatagacattcaagtgatgacaccctatggtaaaacaatggtttccagattccat

SEQ ID NO: 557 - DNA, 60 bp, Artificial Sequence
  Description of Artificial Sequence: Synthetic probe
aaataaagtatagaatattacagtatgtccactcactcttccagggtttccccgatggat

SEQ ID NO: 558 - DNA, 60 bp, Artificial Sequence
  Description of Artificial Sequence: Synthetic probe
tatggttcagtatcaagcccaaaagggacaacaaccatgcagtccctctgtactgtaaga

SEQ ID NO: 559 - DNA, 60 bp, Artificial Sequence
  Description of Artificial Sequence: Synthetic probe
cagtgtagagcatcttcaggcacaaggactacagtattacggcggatgatcagtatagct

SEQ ID NO: 560 - DNA, 60 bp, Artificial Sequence
  Description of Artificial Sequence: Synthetic probe
caaaaagttttggagtaattgagtaaattatccaatatggtatttgacctcctaaacaaa

SEQ ID NO: 561 - DNA, 60 bp, Artificial Sequence
  Description of Artificial Sequence: Synthetic probe
gttttctcaaagtcgtaataaatttgtttagaaattgttgtactgttaatgcccaaccgg

SEQ ID NO: 562 - DNA, 60 bp, Artificial Sequence
  Description of Artificial Sequence: Synthetic probe
cattttatcaattagaaggacaacttttatgaaagcaggataattctaggtgtagtgcta

SEQ ID NO: 563 - DNA, 60 bp, Artificial Sequence
  Description of Artificial Sequence: Synthetic probe
ttttcaagtttttaagacagttaaatactcctatcctgtggtgtctggataaacatacca

SEQ ID NO: 564 - DNA, 60 bp, Artificial Sequence
  Description of Artificial Sequence: Synthetic probe
tgtgtaatccattagcaaggtccttgacagcattttaagctgtaagtttagaaggtttca

SEQ ID NO: 565 - DNA, 60 bp, Artificial Sequence
  Description of Artificial Sequence: Synthetic probe
tatgcttgaatttaagtagattggagctgtgagacagatgattatattctcgacttttct

SEQ ID NO: 566 - DNA, 60 bp, Artificial Sequence
  Description of Artificial Sequence: Synthetic probe
tttattcattttagtgagtggaaggagaggacatttttatgggtctgccacagaaattga

SEQ ID NO: 567 - DNA, 60 bp, Artificial Sequence
  Description of Artificial Sequence: Synthetic probe
tgaacaagcaccaaagtttggtagttggaaagactaaatgaaatcattatgagtatattc

SEQ ID NO: 568 - DNA, 60 bp, Artificial Sequence
  Description of Artificial Sequence: Synthetic probe
catttgcatatttagaggatattcaaatgagatttatgaagacatatggccgtgtggctc

SEQ ID NO: 569 - DNA, 60 bp, Artificial Sequence
  Description of Artificial Sequence: Synthetic probe
atgttccatgcctaacaggtattgagattcaggtctatgtagtagtttatcgtatacatc

SEQ ID NO: 570 - DNA, 60 bp, Artificial Sequence
  Description of Artificial Sequence: Synthetic probe
gctgcagataagtccctttacattaaatgattggaaattctatacccggctaaatgttgt

SEQ ID NO: 571 - DNA, 60 bp, Artificial Sequence
  Description of Artificial Sequence: Synthetic probe
tattttcagggaaaatgtcgcctgcggagtcttctcgtgaagaaagtgtgtatatggcca

SEQ ID NO: 572 - DNA, 60 bp, Artificial Sequence
  Description of Artificial Sequence: Synthetic probe
tttatgtactttgagtgtctgactagagaagcatcatcgctagaattaaggaggatgcct

SEQ ID NO: 573 - DNA, 60 bp, Artificial Sequence
  Description of Artificial Sequence: Synthetic probe
aatttttcgttattcaatgcatgttttctccttacaggaattgcgagcctctcgagtctt

SEQ ID NO: 574 - DNA, 60 bp, Artificial Sequence
  Description of Artificial Sequence: Synthetic probe
aatctcatccagccgttctcacatcaaatcttgcgaactcggaaattagcgttcaatata

SEQ ID NO: 575 - DNA, 60 bp, Artificial Sequence
  Description of Artificial Sequence: Synthetic probe
tgccatgtgtttaagatttccgcatgtataccggcactattaacatatgcaagtattcat

SEQ ID NO: 576 - DNA, 60 bp, Artificial Sequence
  Description of Artificial Sequence: Synthetic probe
taatttctatacgtagtacgtttttgagattttgtgtgttataaagccacatgttatgct

SEQ ID NO: 577 - DNA, 60 bp, Artificial Sequence
  Description of Artificial Sequence: Synthetic probe
gatgtttccgtatgcatttattgtctcggaagtcttgttatttctaggcttttgttcttc

SEQ ID NO: 578 - DNA, 60 bp, Artificial Sequence
  Description of Artificial Sequence: Synthetic probe
tatggacttactcgcaagcagctcgaccgtgatatctgggtataactaactagctataaa

SEQ ID NO: 579 - DNA, 60 bp, Artificial Sequence
  Description of Artificial Sequence: Synthetic probe
tctagagaactattcaaggtatttgagtggaaactataactataagatagctgtaggtgt

SEQ ID NO: 580 - DNA, 60 bp, Artificial Sequence
  Description of Artificial Sequence: Synthetic probe
ctgtaaatatagatttgtggtggcacgaagaggcttcgaataatgtgaccttcatgtttt

SEQ ID NO: 581 - DNA, 60 bp, Artificial Sequence
  Description of Artificial Sequence: Synthetic probe
ggatattactatctcaaattgtcggttcccgtgtgcgctctttcgtgctgcctagtttaa

SEQ ID NO: 582 - DNA, 60 bp, Artificial Sequence
  Description of Artificial Sequence: Synthetic probe
cttttgtcaccattcttgtatgacttgtaaacagtacgcagattcgatatcctattcggc

SEQ ID NO: 583 - DNA, 60 bp, Artificial Sequence
  Description of Artificial Sequence: Synthetic probe
tgtatattacgcagaggatttgtccatctataacatgatcgtcgatcgtcactactttac

SEQ ID NO: 584 - DNA, 9061 bp, Artificial Sequence
  Description of Artificial Sequence: Synthetic polynucleotide sequence
cgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagcgctggcagtccataattgtggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatgtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttacaaaggagtctagaagatcctggcatttcaggaacaagcgggcactgctcgacgcacttgcttcgctcagtatcgctcgggacgcacggcgcgctctacgaactgccgatagacaactgtcacggttaagcgagaaatgaataagaaggctgataattcggatctctgcgagggagatgatatttgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggtggtttttcttttcaccagtgagacgggcaacagctgattgcccttcaccgcctggccctgagagagttgcagcaagcggtccacgctggtttgccccagcaggcgaaaatcctgtttgatggtggttccgaaatcggcaaaatcccttataaatcaaaagaatagcccgagatagggttgagtgttgttccagtttggaacaagagtccactattaaagaacgtggactccaacgtcaaagggcgaaaaaccgtctatcagggcgatggcccacggccgctctagaactagtggatcccccctacgtgcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatccctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctggagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatctgttaatcagaaaaactcagattaatcgacaaattcgatcgcacaaactagaaactaacaccagatctagatagaaatcacaaatcgaagagtaattattcgacaaaactcaaattatttgaacaaatcggatgatatttatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttaccttgatcacggtagagagaattgagagaaagtttttaagattttgagaaattgaaatctgaattgtgaagaagaagagctctttgggtattgttttatagaagaagaagaagaaaagacgaggacgactaggtcacgagaaagctaaggcggtgaagcaatagctaataataaaatgacacgtgtattgagcgttgtttacacgcaaagttgtttttggctaattgccttatttttaggttgaggaaaagtatttgtgctttgagttgataaacacgactcgtgtgtgccggctgcaaccactttgacgccgtttattactgactcgtcgacaaccacaatttctaacggtcgtcataagatccagccgttgagatttaacgatcgttacgatttatatttttttagcattatcgttttattttttaaatatacggtggagctgaaaattggcaataattgaaccgtgggtcccactgcattgaagcgtatttcgtattttctagaattcttcgtgctttatttcttttcctttttgtttttttttgccatttatctaatgcaagtgggcttataaaatcagtgaatttcttggaaaagtaacttctttatcgtataacatattgtgaaattatccatttcttttaattttttagtgttattggatatttttgtatgattattgatttgcataggataatgacttttgtatcaagttggtgaacaagtctcgttaaaaaaggcaagtggtttggtgactcgatttattcttgttatttaattcatatatcaatggatcttatttggggcctggtccatatttaacactcgtgttcagtccaatgaccaataatattttttcattaataacaatgtaacaagaatgatacacaaaacattctttgaataagttcgctatgaagaagggaacttatccggtcctagatcatcagttcatacaaacctccatagagttcaacatcttaaacaaggatatcctgatccgttgacggcgcgccaagcggccgcaaaacccctcacaaatacataaaaaaaattctttatttaattatcaaactctccactacctttcccaccaaccgttacaatcctgaatgttggaaaaaactaactacattgatataaaaaaactacattacttcctaaatcatatcaaaattgtataaatatatccactcacttggacaaattgcccatagttggaaagatgttcaccaagtcaacaagatttatcaatggaaaaatccatctaccaaacttactttcaagaaaatccaaggattatagagtaaaaaatctatgtattattaagtcaaaaagaaaaccaaagtgaacaaatattgatgtacaagtttgagaggataagacattggaatcgtctaaccaggaggcggaggaattccctagacagttaaaagtggccggaatcccggtaaaaaagattaaaatttttttgtagagggagtgcttgaatcatgttttttatgatggaaatagattcagcaccatcaaaaacattcaggacacctaaaattttgaagtttaacaaaaataacttggatctacaaaaatccgtatcggattttctctaaatataactagaattttcataactttcaaagcaactcctcccctaaccgtaaaacttttcctacttcaccgttaattacattccttaagagtagataaagaaataaagtaaataaaagtattcacaaaccaacaatttatttcttttatttacttaaaaaaacaaaaagtttatttattttacttaaatggcataatgacatatcggagatccctcgaacgagaatcttttatctccctggttttgtattaaaaagtaatttattgtggggtccacgcggagttggaatcctacagacgcgctttacatacgtctcgagaagcgtgacggatgtgcgaccggatgaccctgtataacccaccgacacagccagcgcacagtatacacgtgtcatttctctattggaaaatgtcgttgttatccccgctggtacgcaaccaccgatggtgacaggtcgtctgttgtcgtgtcgcgtagcgggagaagggtctcatccaacgctattaaatactcgccttcaccgcgttacttctcatcttttctcttgcgttgtataatcagtgcgatattctcagagagcttttcattcaaaggtatggagttttgaagggctttactcttaacatttgtttttctttgtaaattgttaatggtggtttctgtgggggaagaatcttttgccaggtccttttgggtttcgcatgtttatttgggttatttttctcgactatggctgacattactagggctttcgtgctttcatctgtgttttcttcccttaataggtctgtctctctggaatatttaattttcgtatgtaagttatgagtagtcgctgtttgtaataggctcttgtctgtaaaggtttcagcaggtgtttgcgttttattgcgtcatgtgtttcagaaggcctttgcagattattgcgttgtactttaatattttgtctccaaccttgttatagtttccctcctttgatctcacaggaaccctttcttctttgagcattttcttgtggcgttctgtagtaatattttaattttgggcccgggttctgagggtaggtgattattcacagtgatgtgctttccctataaggtcctctatgtgtaagctgttagggtttgtgcgttactattgacatgtcacatgtcacatattttcttcctcttatccttcgaactgatggttctttttctaattcgtggattgctggtgccatattttatttctattgcaactgtattttagggtgtctctttctttttgatttcttgttaatatttgtgttcaggttgtaactatgggttgctagggtgtctgccctcttcttttgtgcttctttcgcagaatctgtccgttggtctgtatttgggtgatgaattatttattccttgaagtatctgtctaattagcttgtgatgatgtgcaggtatattcgttagtcatatttcaatttcaagcgatcccccgggctgcaggctagctaaaagtacttttcctaggatcgatgggtgttatttgtggataataaattcgggtgatgttcagtgtttgtcgtatttctcacgaataaattgtgtttatgtatgtgttagtgttgtttgtctgtttcagaccctcttatgttatatttttcttttcgtcggtcagttgaagccaatactggtgtcctggccggcactgcaataccatttcgtttaatataaagactctgttatccgtgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgcggccgcatttaaatgggccctgttaactggtaccttaattaaaagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttccccagatc

SEQ ID NO: 585 - protein, 9 aa, Artificial Sequence
  Description of Artificial Sequence: Synthetic peptide
YKATIGADF

What is claimed is:

1. An isolated polynucleotide comprising a nucleic acid sequence selected from the group consisting of SEQ ID NO: 130 and a variant thereof, wherein said variant encodes the same polypeptide as that encoded by the nucleic acid sequence of SEQ ID NO: 130.

2. A DNA construct comprising the polynucleotide of claim 1.

3. The DNA construct of claim 2, further comprising a promoter, wherein the promoter and the polynucleotide are operably linked.

4. The DNA construct of claim 2, wherein the polynucleotide encodes an RNA transcript.

5. The DNA construct of claim 4, wherein the polynucleotide is in a sense or antisense orientation relative to the promoter.

6. The DNA construct of claim 4, wherein the RNA transcript induces RNA interference of the polynucleotide.

7. A plant cell transformed with the DNA construct of claim 2.

8. The DNA construct of claim 6, wherein the RNA transcript is a small interfering RNA.

* * * * *